United States Patent
Howard et al.

(10) Patent No.: US 9,956,298 B2
(45) Date of Patent: *May 1, 2018

(54) PYRROLOBENZODIAZEPINES AND CONJUGATES THEREOF

(71) Applicant: MEDIMMUNE LIMITED, Cambridge (GB)

(72) Inventors: Philip Wilson Howard, Cambridge (GB); Arnaud Tiberghien, Cambridge (GB); Thais Cailleau, Cambridge (GB)

(73) Assignee: Medimmune Limited, Cambridge (GB)

( * ) Notice: Subject to any disclaimer, the term of this patent is extended or adjusted under 35 U.S.C. 154(b) by 0 days. days.

This patent is subject to a terminal disclaimer.

(21) Appl. No.: 15/028,575

(22) PCT Filed: Oct. 10, 2014

(86) PCT No.: PCT/EP2014/071791
§ 371 (c)(1),
(2) Date: Apr. 11, 2016

(87) PCT Pub. No.: WO2015/052321
PCT Pub. Date: Apr. 16, 2015

(65) Prior Publication Data
US 2016/0250344 A1    Sep. 1, 2016

(30) Foreign Application Priority Data

Oct. 11, 2013  (GB) .................................. 1317981.7

(51) Int. Cl.
| | | |
|---|---|---|
| C07D 487/04 | (2006.01) | |
| C07D 519/00 | (2006.01) | |
| A61K 47/48 | (2006.01) | |
| A61K 31/5517 | (2006.01) | |
| A61K 45/06 | (2006.01) | |

(52) U.S. Cl.
CPC .... *A61K 47/48384* (2013.01); *A61K 31/5517* (2013.01); *A61K 45/06* (2013.01); *A61K 47/48569* (2013.01); *A61K 47/48584* (2013.01); *C07D 519/00* (2013.01)

(58) Field of Classification Search
CPC ............................ C07D 487/04; C07D 519/00
See application file for complete search history.

(56) References Cited

U.S. PATENT DOCUMENTS

| | | | |
|---|---|---|---|
| 3,361,742 A | 1/1968 | Julius et al. | |
| 3,523,941 A | 8/1970 | Leimgruber et al. | |
| 3,524,849 A | 8/1970 | Batcho et al. | |
| 3,794,644 A | 2/1974 | Karlyone et al. | |
| 4,185,016 A | 1/1980 | Takanabe et al. | |
| 4,239,683 A | 12/1980 | Takanabe et al. | |
| 4,309,437 A | 1/1982 | Ueda et al. | |
| 4,353,827 A | 10/1982 | Hunkeler et al. | |
| 4,382,032 A | 5/1983 | Hunkeler et al. | |
| 4,386,028 A | 5/1983 | Hunkeler et al. | |
| 4,405,516 A | 9/1983 | Hunkeler et al. | |
| 4,405,517 A | 9/1983 | Hunkeler et al. | |
| 4,407,752 A | 10/1983 | Hunkeler et al. | |
| 4,427,587 A | 1/1984 | Kaneko et al. | |
| 4,427,588 A | 1/1984 | Kaneko et al. | |
| 4,701,325 A | 10/1987 | Ueda et al. | |
| 4,816,567 A | 3/1989 | Cabilly et al. | |
| 4,923,984 A | 5/1990 | Matsumura et al. | |
| 5,418,241 A | 5/1995 | Jegham et al. | |
| 5,583,024 A | 12/1996 | McElroy et al. | |
| 5,674,713 A | 10/1997 | McElroy et al. | |
| 5,700,670 A | 12/1997 | Yamagishi et al. | |
| 6,214,345 B1 | 4/2001 | Firestone et al. | |
| 6,362,331 B1 | 3/2002 | Kamal et al. | |
| 6,562,806 B1 | 5/2003 | Thurston et al. | |

(Continued)

FOREIGN PATENT DOCUMENTS

| | | |
|---|---|---|
| EP | 1813614 | 8/2007 |
| FR | 2027356 | 12/1969 |

(Continued)

OTHER PUBLICATIONS

U.S. Appl. No. 62/051,387, filed Sep. 17, 2014, Flygare et al.

(Continued)

*Primary Examiner* — Bruck Kifle
(74) *Attorney, Agent, or Firm* — Casimir Jones, S.C.; Melissa E. Kolom

(57) ABSTRACT

A compound which is selected from A: and salts and solvates thereof.

A

B:

B

14 Claims, No Drawings

(56) References Cited

U.S. PATENT DOCUMENTS

| | | |
|---|---|---|
| 6,608,192 B1 | 8/2003 | Thurston et al. |
| 6,660,742 B2 | 12/2003 | Lee |
| 6,660,856 B2 | 12/2003 | Wang |
| 6,747,144 B1 | 6/2004 | Thurston et al. |
| 6,884,799 B2 | 4/2005 | Kamal et al. |
| 6,909,006 B1 | 6/2005 | Thurston et al. |
| 7,067,511 B2 | 6/2006 | Thurston et al. |
| 7,049,311 B1 | 8/2006 | Thurston et al. |
| 7,244,724 B2 | 7/2007 | Liu et al. |
| 7,265,105 B2 | 9/2007 | Thurston et al. |
| 7,407,951 B2 | 8/2008 | Thurston et al. |
| 7,429,658 B2 | 9/2008 | Howard et al. |
| 7,498,298 B2 | 3/2009 | Doronina et al. |
| 7,528,126 B2 | 5/2009 | Howard et al. |
| 7,557,099 B2 | 7/2009 | Howard et al. |
| 7,612,062 B2 | 11/2009 | Gregson et al. |
| 7,704,924 B2 | 4/2010 | Thurston et al. |
| 7,723,485 B2 | 5/2010 | Junutula et al. |
| 7,741,319 B2 | 6/2010 | Howard et al. |
| 8,034,808 B2 | 11/2011 | Delavault et al. |
| 8,163,736 B2 | 4/2012 | Gauzy et al. |
| 8,501,934 B2 | 6/2013 | Howard et al. |
| 8,487,092 B2 | 7/2013 | Howard et al. |
| 8,592,576 B2 | 11/2013 | Howard et al. |
| 8,633,185 B2 | 1/2014 | Howard et al. |
| 8,637,664 B2 | 1/2014 | Howard et al. |
| 8,697,688 B2 | 4/2014 | Howard et al. |
| 8,829,184 B2 | 9/2014 | Howard et al. |
| 8,940,733 B2 | 1/2015 | Howard et al. |
| 9,102,704 B2 | 8/2015 | Howard et al. |
| 9,242,013 B2 | 1/2016 | Howard et al. |
| 2003/0195196 A1 | 10/2003 | Thurston et al. |
| 2004/0138269 A1 | 7/2004 | Sun et al. |
| 2004/0198722 A1 | 10/2004 | Thurston et al. |
| 2007/0072846 A1 | 3/2007 | Vishnuvajjala et al. |
| 2007/0092940 A1 | 4/2007 | Eigenbrot et al. |
| 2007/0154906 A1 | 7/2007 | Martin et al. |
| 2007/0185336 A1 | 8/2007 | Rossen et al. |
| 2007/0191349 A1 | 8/2007 | Howard et al. |
| 2007/0232592 A1 | 10/2007 | Delavault et al. |
| 2007/0249591 A1 | 10/2007 | Howard et al. |
| 2008/0090812 A1 | 4/2008 | Pepper et al. |
| 2008/0092940 A1 | 4/2008 | Nakajima |
| 2008/0213289 A1 | 9/2008 | Francisco et al. |
| 2009/0148942 A1 | 6/2009 | Mcdonagh et al. |
| 2011/0160192 A1 | 6/2011 | Howard et al. |
| 2011/0256157 A1 | 10/2011 | Howard et al. |
| 2013/0028917 A1 | 1/2013 | Howard et al. |
| 2013/0266595 A1 | 10/2013 | Flygare et al. |
| 2014/0030279 A1 | 1/2014 | Polakis et al. |
| 2014/0030280 A1 | 1/2014 | Polakis |
| 2014/0066435 A1 | 3/2014 | Howard et al. |
| 2014/0120118 A1 | 5/2014 | Howard |
| 2014/0127239 A1 | 5/2014 | Howard |
| 2014/0234346 A1 | 8/2014 | Howard et al. |
| 2014/0274907 A1 | 9/2014 | Howard et al. |
| 2014/0286970 A1 | 9/2014 | Jeffrey et al. |
| 2014/0294868 A1 | 10/2014 | Howard et al. |
| 2014/0302066 A1 | 10/2014 | Jeffrey et al. |
| 2015/0111880 A1 | 4/2015 | Howard et al. |
| 2015/0126495 A1 | 5/2015 | Howard et al. |
| 2015/0133435 A1 | 5/2015 | Howard et al. |
| 2015/0158869 A1 | 6/2015 | Howard |
| 2015/0183883 A1 | 7/2015 | Asundi et al. |
| 2015/0265722 A1 | 9/2015 | Van Berkel |
| 2015/0273077 A1 | 10/2015 | Van Berkel |
| 2015/0273078 A1 | 10/2015 | Van Berkel |
| 2015/0274737 A1 | 10/2015 | Howard et al. |
| 2015/0283258 A1 | 10/2015 | Van Berkel |
| 2015/0283262 A1 | 10/2015 | Van Berkel |
| 2015/0283263 A1 | 10/2015 | Van Berkel |
| 2015/0297746 A1 | 10/2015 | Van Berkel |
| 2015/0315196 A1 | 11/2015 | Howard et al. |
| 2015/0344482 A1 | 12/2015 | Howard et al. |
| 2016/0015828 A1 | 1/2016 | Torgor |
| 2016/0031887 A1 | 2/2016 | Howard et al. |

FOREIGN PATENT DOCUMENTS

| | | |
|---|---|---|
| FR | 2586683 | 3/1987 |
| GB | 1299198 | 12/1972 |
| GB | 2053894 | 2/1981 |
| JP | 53-82792 | 7/1978 |
| JP | 57131791 | 8/1982 |
| JP | 58180487 | 10/1983 |
| WO | 92/19620 | 11/1992 |
| WO | 93/18045 | 9/1993 |
| WO | WO 95/04718 | 2/1995 |
| WO | WO 00/03291 | 1/2000 |
| WO | WO 00/12506 | 3/2000 |
| WO | WO 00/12507 | 3/2000 |
| WO | WO 00/12508 | 3/2000 |
| WO | WO 00/12509 | 3/2000 |
| WO | WO 01/16104 | 3/2001 |
| WO | WO 2004/043963 | 5/2004 |
| WO | WO 2005/023814 | 3/2005 |
| WO | WO 2005/040170 | 5/2005 |
| WO | WO 2005/042535 | 5/2005 |
| WO | WO 2005/079479 | 9/2005 |
| WO | WO 2005/082023 | 9/2005 |
| WO | WO 2005/085177 | 9/2005 |
| WO | WO 2005/085250 | 9/2005 |
| WO | WO 2005/085251 | 9/2005 |
| WO | WO 2005/085259 | 9/2005 |
| WO | WO 2005/085260 | 9/2005 |
| WO | WO 2005/105113 | 11/2005 |
| WO | WO 2005/110423 | 11/2005 |
| WO | WO 2006/111759 | 10/2006 |
| WO | WO 2007/039752 | 4/2007 |
| WO | WO 2007/085930 | 8/2007 |
| WO | WO 2008/010101 | 1/2008 |
| WO | WO 2008/047242 | 4/2008 |
| WO | WO 2008/050140 | 5/2008 |
| WO | WO 2008/070593 | 6/2008 |
| WO | WO 2009/016516 | 2/2009 |
| WO | WO 2009/052249 | 4/2009 |
| WO | WO 2009/060208 | 5/2009 |
| WO | WO 2009/060215 | 5/2009 |
| WO | WO 2009/117531 | 9/2009 |
| WO | WO 2010/010347 | 1/2010 |
| WO | WO 2010/043877 | 4/2010 |
| WO | WO 2010/043880 | 4/2010 |
| WO | WO 2010/091150 | 8/2010 |
| WO | WO 2011/023883 | 3/2011 |
| WO | WO 2011/038159 | 3/2011 |
| WO | WO 2011/100227 | 8/2011 |
| WO | WO 2011/128650 | 10/2011 |
| WO | WO 2011/130598 | 10/2011 |
| WO | WO 2011/130613 | 10/2011 |
| WO | WO 2011/130615 | 10/2011 |
| WO | WO 2011/130616 | 10/2011 |
| WO | WO 2012/112708 | 8/2012 |
| WO | WO 2012/128868 | 9/2012 |
| WO | WO 2013/041606 | 3/2013 |
| WO | WO 2013/053871 | 4/2013 |
| WO | WO 2013/053872 | 4/2013 |
| WO | WO 2013/053873 | 4/2013 |
| WO | WO 2013/055987 | 4/2013 |
| WO | WO 2013/055990 | 4/2013 |
| WO | WO 2013/055993 | 4/2013 |
| WO | WO 2013/164592 | 11/2013 |
| WO | WO 2013/164593 | 11/2013 |
| WO | WO 2014/011518 | 1/2014 |
| WO | WO 2014/011519 | 1/2014 |
| WO | WO 2014/057072 | 4/2014 |
| WO | WO 2014/057073 | 4/2014 |
| WO | WO 2014/057074 | 4/2014 |
| WO | WO 2014/057113 | 4/2014 |
| WO | WO 2014/057114 | 4/2014 |
| WO | WO 2014/057115 | 4/2014 |
| WO | WO 2014/057117 | 4/2014 |
| WO | WO 2014/057118 | 4/2014 |

(56) References Cited

FOREIGN PATENT DOCUMENTS

| WO | WO 2014/057119 | 4/2014 |
| --- | --- | --- |
| WO | WO 2014/057120 | 4/2014 |
| WO | WO 2014/057122 | 4/2014 |
| WO | WO 2014/022679 | 6/2014 |
| WO | WO 2014/096365 | 6/2014 |
| WO | WO 2014/096368 | 6/2014 |
| WO | WO 2014/130879 | 8/2014 |
| WO | WO 2014/140174 | 9/2014 |
| WO | WO 2014/140862 | 9/2014 |
| WO | WO 2014/159981 | 10/2014 |
| WO | WO 2014/174111 | 10/2014 |
| WO | WO 2015/052322 | 4/2015 |
| WO | WO 2015/052532 | 4/2015 |
| WO | WO 2015/052533 | 4/2015 |
| WO | WO 2015/052534 | 4/2015 |
| WO | WO 2015/052535 | 4/2015 |
| WO | WO 2015/095124 | 6/2015 |
| WO | WO2015/159076 | 10/2015 |

OTHER PUBLICATIONS

U.S. Appl. No. 14/774,535, filed Sep. 10, 2015, Howard et al.
U.S. Appl. No. 14/995,944, filed Jan. 14, 2016, Howard et al.
Adair, J.R. et al., "Antibody-drug conjugates—a perfect synergy," Exp. Opin. Biol. Ther. (2012) 16 pages.
Adams et al., "Molecular modelling of a sequence-specific DNA-binding agent based on the pyrrolo [2,1-c][1,4]benzodiazepines," Pharm. Pharmacol. Commun. (1999) 5:555-560.
Aird, R.E. et al., "ABCB1 genetic polymorphism influences the pharmacology of the new pyrrolobenzodiazepine derivative SJG-136," Pharmacogenomics Journal (2008) 8(4):289-296.
Alley, M.C. et al., "SJG-136 (NSC 694501), a novel rationally designed DNA minor groove interstrand cross-linking agent with potent and broad spectrum antitumor activity. Part 2: Efficacy evaluations," Cancer Res. (2004) 64:6700-6706.
Alley, M.C., "Efficacy evaluations of SJG-136 (NSC 694501), a novel pyrrolobenzodiazepine dimer with broad spectrum antitumor activity," Proceedings of the American Association for Cancer Research Annual Meeting (Mar. 2002) 43:63.
Althius, T. H. and Hess, H. J., "Synthesis and Identification of the Major Metabolites of Prazosin Formed in Dog and Rat," J. Medicinal Chem. (1977) 20(1):146-148.
Antonow, D. et al., "Synthesis of DNA-Interactive Pyrrolo [2,1-c][1,4] benzodiazepines (PBDs)" Chemical Reviews, 2011, 111(4):2815-2864.
Antonow, D. et al., J. Med. Chem. 53, 2927-2941, (2010).
Antonow, D. et al.,"Parallel synthesis of a novel C2-aryl pyrrolo[2,1-c][1,4]benzodiazepine (PBD) library," J. Comb. Chem. (2007) 9:437-445.
Arima et al., "Studies on Tomaymycin, a New Antibiotic. I. Isolation and Properties of Tomaymycin," J. Antibiotics (1972) 25:437-444.
Arnould, S., "Impact on the cell cycle and involvement of ATM, ATR, chk1 and chk2 kinases in the cytotoxicity of SJG-136, a new pyrrolobenzodiazepine dimer," Proceedings of the American Association for Cancer Research Annual Meeting (Mar. 2004) 45:1298, Abstract No. 5618.
Arnould, S., "Time-dependent cytotoxicity induced by SJG-136 (NSC 694501): influence of the rate of interstrand cross-link formation on DNA damage signaling," Mol. Canc. Therap. (2006) 5(6):1602-1609.
Berge et al., "Pharmaceutical Salts," J. Pharm. Sci. (1977) 66:1-19.
Berry, J. M. et al., "Solid-phase synthesis of DNA-interactive pyrrolo [2,1-c][1,4]benzodiazepines," Tetrahedron Letters (2000) 41:6171-6174.
Bose et al., "New Approaches to Pyrrolo[2,1-c][1,4]benzodiazepines: Synthesis, DNA-binding and cytotoxicity of DC-81," Tetrahedron, 48, 751-758 (1992).
Bose, D.S. et al., "Effect of linker length on DNA-binding affinity, cross-linking efficiency and cytotoxicity of C8 linked pyrrolobenzodiazepine dimers," J. Chem. Soc. Chem. Commun. (1992) 20:1518-1520.
Bose, D.S. et al., "Rational Design of a Highly Efficient Irreversible DNA Interstrand Cross-Linking Agent Based on the Pyrrolobenzodiazepine Ring System," J. Am. Chem. Soc., 114, 4939-4941 (1992).
Buhrow, S.A., "LC-MS/MS assay and dog pharmacokinetics of the dimeric pyrrolobenzodiazepine SJG-136 (NSC 694501)," J. Chromat. B: Anal. Tech. Biomed. Life Sci. (2006) 840(1):56-62.
Burke, P.J. et al., "Anti-CD70 antibody-drug conjugates containing pyrrolobenzodiazepine dimers demonstrate robust antitumor activity," AACR National Meeting, Apr. 2012, Chicago, Illinois, Abstract No. 4631.
Burke, P.J. et al., "Novel immunoconjugates comprised of streptonigrin and 17-amino-geldanamycin attached via a dipeptide-p-aminobenzyl-amine linker system," Bioorg. Med. Chem. Lett., Apr. 2009, 19(10):2650-2653.
Calcutt, M.W., "Determination of chemically reduced pyrrolobenzodiazepine SJG-136 in human plasma by HPLC-MS/MS: application to an anticancer phase I dose escalation study," J. Mass Spectrom. (2008) 43(1):42-52.
Cancer, 2012, http://wiki.answers.com/Q/How-many-different-types of cancer are there.
Cancer2, 2012, http://en.wikipedia.org/wiki/Management of cancer.
Carter, P., "Potent antibody therapeutics by design," (2006) Nature Reviews Immunology 6:343-357.
Chen, Z. et al., "A novel approach to the synthesis of cytotoxic C2-C3 unsaturated pyrrolo[2,1-c][1,4]benzodiazepines (PBDs) with conjugated acrylyl C2-substituents," Biorg. Med. Chem. Lett. (2004) 14:1547-1549.
Cheung, A., "Direct liquid chromatography determination of the reactive imine SJG-136 (NSC 694501)," J. Chromat. B: Anal. Techn. Biomed. Life Sci. (2005) 822(1-2):10-20.
Cipolla, L., "Pyrrolo[2,1-c][1,4]benzodiazepine as a scaffold for the design and synthesis of anti-tumour drugs," Anti-Cancer Agents in Medicinal Chemistry (Jan. 2009) 9(1):1-31.
Clackson et al., "Making antibody fragments using phage display libraries," (1991) Nature, 352:624-628.
Clingen, P.H., "The role of nucleotide excision repair and homologous recomination in the sensitivity of mammalian cells to the minor groove crosslinking pyrrolo[2,1-c][1,4]benzodiazepine dimer SJG-136.(NSC694501)," Proceedings of the American Association for Cancer Research Annual Meeting (Jul. 2003) 44:524.
Clingen, P.H., "The XPF-ERCC1 endonuclease and homologous recombination contribute to the repair of minor groove DNA interstrand crosslinks in mammalian cells produced by the pyrrolo[2,1-c][1,4]benzodiazepine dimer SJG-136," Nucl. Acids Res. (2005) 33(10):3283-3291.
ClinicalTrial, 2011, http://www.nature.com/news/2011/110928/full/477526a.html.
Cooper, N. et al., "Synthesis of novel PBDs as anti-tumour agents," Chem. Commun. (2002) 16:1764-1765.
Cooper, N., "Design, Synthesis and Evaluation of Novel C2-Aryl Pyrrolobenzodiazepines as Potential Anticancer Agents," Thesis submitted to School of Pharmacy, University of London, Dated Oct. 5, 2006.
Courtney, S. M. et al., "A new convenient procedure for the synthesis of pyrrolo [2,1-c][1,4]benzodiazepines", Tetrahedron Letters, vol. 34, No. 33, 5327-28 (1993).
Cree et al., "Methotrexate chemosensitivity by ATP luminescence in human leukemia cell lines and in breast cancer primary cultures: comparison of the TCA-100 assay with a clonogenic assay," (1995) AntiCancer Drugs 6:398-404.
Crouch et al., "The use ATP bioluminescence as a measure of cell proliferation and cytotoxicity," (1993) J. lmmunol. Meth. 160:81-88.
Dall'Acqua, W. F. et al., "Antibody humanization by framework shuffling" Methods, 36, 43-60 (2005).
Dattolo, G. et al., "Polycondensed nitrogen heterocycles. IX. 5,6-dihydro-7H-pyrrolo [1,2-d][1,4]benzodiazepin-6-one," J. Heterocyclic. Chem. (1980) 17:701-703.

(56) References Cited

OTHER PUBLICATIONS

"Dennis et al., (2002)""Albumin Binding As a General Strategy For Improving the Pharmacokinetics of Proteins""J Biol Chem. 277:35035-35043".

Dong, Q. et al., "Reductive cleavage of TROC groups under neutral conditions with cadmium-lead couple," Tetrahedron Lett. (1995) 36(32):5681-5682.

"Dornan et al.,""Therapeutic potential of an anti-CD79b antibody-drug conjugate anti-CD79b-vc-MMAE, for the treatment of non-Hodgkin lymphoma,""(2009) Blood 114(13):2721-2729".

Doronina, S.O. et al., "Development of potent monoclonal antibody auristatin conjugates for cancer therapy," Nature Biotech. (2003) 21:778-784.

Dorwald, F.Z., Side Reactions in Organic Synthesis: a Guide to Successful Synthesis Design, Weinheim: Wiley-VCH Verlag GmbH & Co., KGaA (2005) Preface.

Doyle, M., "Response of *Staphylococcus aureus* to subinhibitory concentrations of a sequence-selective, DNA minor groove cross-linking pyrrolobenzodiazepine dimer," J. Antimicrob. Chemo., Aug. 2009, 64(5):949-959.

Dubowchik et al, Bioorganic & Medicinal Chemistry Letters, 8:3341-3346, (1998).

Dubowchik et al., "Cathepsin B-Labile Dipeptide Linkers for Lysosomal Release of Doxorubicin from Internalizing Immunoconjugates: Model Studies of Enzymatic Drug Release and Antigen-Specific In Vitro Anticancer Activity," Bioconjugate Chem. (2002) 13, 855-869.

Dupont, C. et al., "Synthesis of rhazinilam analogue acting as an inhibitor of tubulin assembly," Tetrahedron Lett. (2000) 41:5853-5856.

Erickson et al., "Antibody-Maytansinoid Conjugates Are Activated in Targeted Cancer Cells by Lysosomal Degradation and Linker-Dependent Intracellular Processing," (2006) Cancer Res. 66(8): 1-8.

Farmer, J.D. et al., "Synthesis and DNA crosslinking ability of a dimeric anthramycin analog," Tetrahedron Letters (1988) 29(40):5105-5108, Abstract only.

Farmer, J.D. et al., "DNA binding properties of a new class of linked anthramycin analogs,", Chemical Abstracts, Abstract No. 239940r, vol. 114, No. 25, 25 899-903 (1991).

Fey, T. et al., "Silica-supported TEMPO catalyst: synthesis and application in the anelli oxidation of alcohols," J. Org. Chem. (2001) 66:8154-8159.

Firsching, A. et al., "Antiproliferative and angiostatic activity of suramin analogues," Cancer Res. (1995) 55:4957-4961.

Foloppe, M.P. et al., "DNA-binding properties of pyrrolo [2,1-c][1,4]benzodiazephine N10-C11 amidines," Eur. J. Med. Chem., 31, 407-410 (1996).

Fujisawa Pharmaceutical Co. Ltd., "Benzodiazepine derivatives," SciFinder Scholar, 2-3 (2002).

Fujisawa Pharmaceutical Co., Ltd., Abstract No. 139983k, "Benzodiazepine derivatives", Chemical Abstracts, vol. 99, No. 17, 603 (1983).

Fujisawa Pharmaceutical Co., Ltd., Abstract No. 72145x, "Benzodiazepine derivatives", Chemical Abstracts, vol. 98, No. 9, 638 (1983).

Fukuyama, T. et al., "Total Synthesis of (+)-Porothramycin B," Tetrahedron Letters, vol. 34, 16, 2577-2580 (1993).

Gallmeier, E., "Targeted disruption of FANCC and FANCG in human cancer provides a preclinical model for specific therapeutic options," Gastroenterology (2006) 130(7):2145-2154.

Gavezzotti, A., "Are crystal structures predictable?" Acc. Chem. Res. (1994) 27:309-314.

Getz et al., "A Comparison between the Sulfhydryl Reductants Tris(2-carboxyethyl)phosphine and Dithiothreitol for Use in Protein Biochemistry," (1999) Anal. Biochem. vol. 273:73-80.

Greene, T.W. and Wuts, P.G.M., Protective Groups in Organic Synthesis, John Wiley & Sons, 2nd ed., Ch 7, 315-345 (1991).

Greene, T.W. et al., Protective Groups in Organic Synthesis, John Wiley & Sons (1999) 3rd Edition, 23-200, 503-549, 633-647.

Gregson, S. et al., "Synthesis of a novel C2/C2'-exo unsaturated pyrrolobenzodiazepine cross-linking agent with remarkable DNA binding affinity and cytotoxicity," Chemical Communications, 797-798 (1999).

Gregson, S.J. et al., "Effect of C2/C3-endo unsaturation on the cytotoxicity and DNA-binding reactivity of pyrrolo-[2,1-c][1,4]-benzodiazepines," Bioorg. Med. Chem. Lett. (2000) 10(16):1849-1851.

Gregson, S.J. et al., "Linker length modulates DNA cross-linking reactivity and cytotoxic potency of C8/C8'ether-linked C2-exo-unsaturated pyrrolo [2,1-c][1,4]benzodiazepine (PBD) dimers," J. Med. Chem. (2004) 1161-1174.

Gregson, S.J. et al., "Synthesis of the first example of a C2-C3/C2'-C3'-endo unsaturated pyrrolo[2,1-c][1,4]benzodiazepine dimer," Biorg. Med. Chem. Lett. (2001) 11:2859-2862.

Gregson, S.J. et al., "Synthesis of the first examples of A-C8/C-C2 amide-linked pyrrolo [2,1c][1,4]benzodiazepine dimers," Biorg. Med. Chem. Lett. (2003) 13:2277-2280.

Gregson, S.J. et al., "Design, Synthesis and Evaluation of a Novel Pyrrolobenzodiazepine DNA-Interactive Agent with Highly Efficient Cross-Linking Ability and Potent Cytotoxicity", J. Med. Chem., 44: 737-748 (2001).

Gregson, S.J. et al., "Effect of C2-exo Unsaturation on the Cytotoxicity and DNA-Binding Reactivity of Pyrrolo[2,1-c][1,4]benzodiazepines", Bioorganic & Medicinal Chemistry Letters, 10: 1845-1847 (2000).

Guichard, S.M., "Influence of P-glycoprotein expression on in vitro cytotoxicity and in vivo antitumour activity of the novel pyrrolobenzodiazepine dimer SJG-136," Eur. J. Cancer (2005) 41(12):1811-1818.

Guiotto, A. et al., "Synthesis of novel C7-aryl substituted pyrrolo [2,1-c][1,4]benzodiazepines (PBDs) via Pro-N10-troc protection and suzuki coupling," Bioorganic & Medicinal Chemistry Letters, 8, No. 21, 3017-3018 (1998).

Hadjivassileva, T., "Antibacterial activity of pyrrolobenzodiazepine dimers, a novel group of DNA-binding compounds," Abstracts of the Interscience Conference on Antimicrobial Agents and Chemotherapy (Oct.-Nov. 2004).

Hadjivassileva, T., "Interactions of pyrrolobenzodiazepine dimers and duplex DNA from methicillin-resistant *Staphylococcus aureus*," Int. J. Antimicrob. Agents (2007) 29(6):672-678.

Hadjivassileva, T., "Pyrrolobenzodiazepine dimers: novel sequence-selective, DNA-interactive, cross-linking agents with activity against Gram-positive bacteria," J. Antimicrob. Chemo. (2005) 56(3):513-518.

Hamaguchi, A., "DNA cross-linking and in vivo antitumour activity of the extended pyrrolo [2,1-c][1,4]benzodiazepine dimer SG2057 (DRG-16)," EJC Supplements (Nov. 2006) 4(12):96.

Hamann P "Monoclonal antibody-drug conjugates," (2005) Expert Opin. Ther. Patents 15(9):1087-1103.

Hamblett et al., "Effects of Drug Loading on the Antitumor Activity of a Monoclonal Antibody Drug Conjugate," (2004) Clin. Cancer Res. 10:7063-7070.

Hara et al., "DC 102, a new glycosidic pyrrolo(1,4)benzodiazepine antibiotic produced by *Streptomyces* sp.", J. Antibiotics, 41, 702-704 (1988).

Hartley, J.A. et al., "SG2285, a novel C2-aryl-substituted pyrrolobenzodiazepine dimer prodrug that cross-links DNA and exerts highly potent antitumor activity," Cancer Res., Sep. 2010, 70(17):6849-6858.

Hartley, J.A. et al., "SJG-136 (NSC 694501), a novel rationally designed DNA minor groove interstrand cross-linking agent with potent and broad spectrum antitumor activity. Part 1: Cellular pharmacology, in vitro and initial in vivo antitumor activity," Cancer Res. (2004) 64:6693-6699.

Hartley, J.A., "In vitro antitumor activity and in vivo DNA interstrand crosslinking by the novel pyrrolobenzodiazepine dimer SJG-136 (NSC 694501)," Proceedings of the American Association for Cancer Research Annual Meeting (Mar. 2002) 43:489.

Hartley, J.A., "SJG-136 (NSC-D694501)—a novel DNA sequence specific minor groove crosslinking agent with significant antitumor activity," Proceedings of the American Association for Cancer Research Annual Meeting (Mar. 2000) 41:425.

(56) References Cited

OTHER PUBLICATIONS

Hochhauser, D., "Phase I study of sequence-selective minor groove DNA binding agent SJG-136 in patients with advanced solid tumors," Clin. Cancer Res., Mar. 2009, 15(6):2140-2147.
Hochlowski, J. et al., "Abbeymycin, a new anthramycin-type antibiotic produced by a streptomycete," J. Antibiotics, 40, 145-148 (1987).
Howard, P.W. et al., "Design, synthesis and biological evaluation of ZC-423, a novel C2-aryl substituted pyrrolobenzodiazepine (PBD) dimer," Clinical Cancer Research (2005) 11(23):9015S-9016S (A205).
Howard, P.W. et al., "Synthesis of a novel C2/C2'-aryl-substituted pyrrolo [2,1-c][1,4]benzodiazepine dimer prodrug with improved water solubility and reduced DNA reaction rate," Bioorg. Med. Chem., Sep. 2009, In Press, 4 pages now: Sep. 2009, 19:6463-6466.
Howard, P.W. et al., "The design, synthesis and biological evaluation of a set of C2-aryl substituted pyrrolo [2,1c][1,4]benzodiazepine dimers," EJC Supplements (2006) 4(12):95—Poster Abstract 301.
Howard, P.W., "Design, synthesis and biological evaluation of novel C2-aryl-substituted pyrrolo [2,1-c][1,4]benzodiazepine monomers," Proceedings of the American Association for Cancer Research Annual Meeting (Apr. 2006) 47:132.
Hurley, L. and Needham-Vandevanter, D., "Covalent Binding of Antitumor Antibiotics in the Minor Groove of DNA. Mechanism of Action of CC-1065 and the Pyrrolo(1,4)benzodiazepines," Acc. Chem. Res., 19, 230-237 (1986).
Itoh et al., "Sibanomicin, a new pyrrolo(1,4)benzodiazepine antitumor antibiotic produced by a *Micromonospora* sp." J. Antibiotics, 41, 1281-1284 (1988).
Janjigian, Y.Y., "A phase I trial of SJG-136 (NSC#694501) in advanced solid tumors," Cancer Chemotherapy and Pharmacology , Aug. 2009, 65(5):833-838.
Jeffrey et al., Bioconjugate Chemistry, 5, 2006, 17, 831-840.
Jeffrey, S.C., "Design, synthesis, and in vitro evaluation of dipeptide-based antibody minor groove binder conjugates," J. Med. Chem. (2005) 48(5):1344-1358.
Jespers, L. S., "Guiding the Selection of Human Antibodies from Phage Display Repertoires to a Single Epitope of an Antigen" Nature Biotech., 12, 889-903 (1994).
Jia, L., "Interspecies differences in pharmacokinetics and time-dissociated toxicokinetics of SJG-136," Proceedings of the American Association for Cancer Research Annual Meeting (Mar. 2004) 45:487.
Jia, L., "Use of the comet assay as a surrogate biomarker for the in vivo measurement of DNA damage to lymphocytes," Proceedings of the American Association for Cancer Research Annual Meeting (Mar. 2004) 45:452-453.
Jordan, V.C., "Tamoxifen: a most unlikely pioneering medicine," Nature Reviews: Drug Discovery (2003).
Kamal et al., "Synthesis and DNA-binding affinity of A-C8/C-C2 alkoxyamido-linked pyrrolo [2,1-c][1,4]benzodiazepine dimers" Biorg. Med. Chem. Lett. (2003) 13(22):3955-3958.
Kamal, A. et al., "Design, synthesis and evaluation of new noncrosslinking pyrrolobenzodiazepine dimers with efficient DNA binding ability and potent antitumor activity," J. Med. Chem. (2002) 45:4679-4688.
Kamal, A., "Development of pyrrolo [2,1-c][1,4]benzodiazepine beta-galactoside prodrugs for selective therapy of cancer by ADEPT and PMT," Chemmedchem (2008) 3:794-802.
Kamal, A., "Remarkable DNA binding affinity and potential anticancer activity of pyrrolo [2,1-c][1,4]benzodiazepine-naphthalamide conjugates linked through piperazine side-armed alkane spacers," Bioorg. Med. Chem. (2008) 16(15):7218-7224.
Kamal, A., "Remarkable enhancement in the DNA-binding ability of C2-fluoro substituted pyrrolo [2,1-c][1,4]benzodiazepines and their anticancer potential," Bioorg. Med. Chem., Jan. 2009, 17(4):1557-1572.
Kamal, A., "Synthesis of fluorinated analogues of SJG-136 and their DNA-binding potential," Bioorg. Med. Chem. Lett (2004) 14(22):5699-5702.
Kamal, A., et al., "An Efficient Synthesis of Pyrrolo [2,1-c][1,4] Benzodiazepine Antibiotics via Reductive Cyclization," Bioorg. Med. Chem. Ltrs, 7, No. 14, 1825-1828 (1997).
Kamal, A., et al., "Synthesis of Pyrrolo [2,1-c][1,4]—Benzodiazepene Antibiotics: Oxidation of Cyclic Secondary Amine with TPAP", Tetrahedron, v. 53, No. 9, 3223-3230 (1997).
Kamal, et al., "Synthesis of pyrrolo [2,1-c][1,4]benzodiazepines via reductive cyclization of w-azido carbonyl compounds by TMSI: an efficient preparation of antibiotic DC-81 and its dimers," Biorg. Med. Chem. Lett. (2000) 10:2311-2313.
Kaneko, T. et al., "Bicyclic and tricyclic analogues of anthramycin," J. Med. Chem. (1985) 28:388-392.
Kang, G.-D. et al., "Synthesis of a novel C2-aryl substituted 1,2-unsaturated pyrrolobenzodiazepine," Chem. Commun. (2003) 1688-1689.
Kohler et al., "Continuous cultures of fused cells secreting antibody of predefined specificity," (1975) Nature 256:495-497.
Kohn, K., "Anthramycin," Antibiotics III, Springer-Verlag, NY, 3-11 (1975).
Konishi, M. et al., "Chicamycin, a new antitumor antibiotic II. Structure determination of chicamycins A and B," J. Antibiotics, 37, 200-206 (1984).
Kovtun et al., "Antibody-Drug Conjugates Designed to Eradicate Tumors with Homogeneous and Heterogeneous Expression of the Target Antigen," (2006) Cancer Res. 66(6):3214-3121.
Kunimoto et al., "Mazethramycin, a new member of anthramycin group antibiotics," J. Antibiotics, 33, 665-667 (1980).
Lambert J., "Drug-conjugated monoclonal antibodies for the treatment of cancer," (2005) Current Opin. in Pharmacal. 5:543-549.
Langley, D.R. and Thurston, D.E., "A versatile and efficient synthesis of cathinolamine-containing pyrrolo[1,4]benzodiazepines via the cyclization of N-92-aminobenzoyl)pyrrolidine-2-carboxaldehyde diethyl thioacetals: total synthesis of prothracarcin," J. Org. Chem., 52, 91-97 (1987).
Langlois, N. et al., "Synthesis and cytotoxicity on sensitive and doxorubicin-resistant cell lines of new pyrrolo [2,1-c][1,4]benzodiazepines related to anthramycin," J. Med. Chem. (2001) 44:3754-3757.
Law et al., "Lymphocyte Activation Antigen CD70 Expressed by Renal Cell Carcinoma Is a Potential Therapeutic Target for Anti-CD70 Antibody-Drug Conjugates," (2006) Cancer Res. 66(4):2328-2337.
Leber, J.D. et al., "A revised structure for sibiromycin," J. Am. Chem. Soc., 110, 2992-2993 (1988).
Leimgruber, W. et al., "Isolation and characterization of anthramycin, a new antitumor antibiotic," J. Am. Chem. Soc., 87, 5791-5793 (1965).
Leimgruber, W. et al., "The structure of anthramycin," J. Am. Chem. Soc., 87, 5793-5795 (1965).
Leimgruber, W. et al., "Total synthesis of anthramycin," J. Am. Chem. Soc., 90, 5641-5643 (1968).
Lonberg, "Fully Human antibodies from transgenic mouse and phage display platforms" Curr. Opinion, 20(4), 450-459 (2008).
Lown et al., "Molecular Mechanism of Binding of Pyrrolo(1,4)benzodiazepine antitumour agents to deoxyribonucleic acid—anthramycin and tomaymycin," Biochem. Pharmacol. (1979), 28 (13), 2017-2026.
Marin, D., "Voltammetric studies of the interaction of pyrrolo [2,1-c][1,4]benzodiazepine (PBD) monomers and dimers with DNA," J. Electroanal. Chem. (2006) 593(1-2):241-246.
Marks et al., "By-passing Immunization, Human Antibodies from V-gene Libraries Displayed on Phage," (1991) J. Mol. Biol., 222:581-597.
Martin, C. et al., "Sequence-selective interaction of the minor-groove interstrand cross-linking agent SJG-136 with naked and cellular DNA: footprinting and enzyme inhibition studies," Biochem. (2005) 44(11):4135-4147.
McDonagh, "Engineered antibody-drug conjugates with defined sites and stoichiometries of drug attachment," (2006) Protein Eng. Design & Sel. 19(7): 299-307.

(56) References Cited

OTHER PUBLICATIONS

Miller et al., "Design, Construction, and In Vitro Analyses of Multivalent Antibodies," (2003) Jour. of Immunology 170:4854-4861.
Mori, M. et al., "Total syntheses of prothracarcin and tomaymycin by use of palladium catalyzed carbonylation," Tetrahedron (1986) 42(14):3793-3806.
Morrison et al., "Chimeric human antibody molecules: Mouse antigen-binding domains with human constant region domains," (1984) Proc. Natl. Acad. Sci. USA, 81:6851-6855.
Mountzouris, J.A. et al., "Comparison of a DSB-120 DNA interstrand cross-linked adduct with the corresponding bis-Tomamycin adduct," J. Med. Chem. (1994) 37:3132-3140.
Nagasaka, T. and Koseki, Y., "Stereoselective Synthesis of Tilivalline," Journal of Organic Chemistry, vol. 63, No. 20, 6797-6801 (1998).
Nagasaka, T. et al., "Stereoselective Synthesis of Tilivalline," Tetrahedron Letters, 30:14, 1871-1872 (1989).
Narayanaswamy, M., "A novel HPLC/MS assay to measure DNA interstrand cross-linking efficacy in oligonucleotides of varying sequence," EJC Supplements (Nov. 2006) 4(12):92-93.
Narayanaswamy, M., "An assay combining high-performance liquid chromatography and mass spectrometry to measure DNA interstrand cross-linking efficiency in oligonucleotides of varying sequences," Anal. Biochem. (2008) 374(1):173-181.
Narayanaswamy, M., "Use of HPLC-MS to characterize novel mono and intrastrand cross-linked DNA adducts formed by the sequence-selective DNA-interactive agent SJG-136," Proceedings of the American Association for Cancer Research Annual Meeting (Apr. 2007) 48:760-761.
Narukawa, Y., "General and efficient synthesis of 2-alkylcarbapenems synthesis of dethia carba analogs of clinically useful carbapenems via palladium-catalyzed cross-coupling reaction," Tetrahedron (1997) 53:539-556.
O'Neil, Chemical Abstract No. 171573p, "The synthesis of Functionalized Pyrrolo-[2,1-c][1,4]-Benzodiazepines", Chemical Abstracts, vol. 126, No. 13, 618 (1997).
O'Neil, I.A., et al., "The Synthesis of Functionalized Pyrrolo-[2,1-c][1,4]-Benzodiazepines," Synlett, 75-78 (1997).
O'Neil, I.A. et al., "DPPE: A Convenient Replacement for Triphenylphosphine in the Staudinger and Mitsunobu Reactions", Tetrahedron Letters, vol. 39, No. 42, 7787-7790 (1998).
Payne, G. "Progress in immunoconjugate cancer therapeutics," (2003) Cancer Cell 3:207-212.
Pepper, C., "Fludarabine-mediated suppression of the excision repair enzyme ERCC1 contributes to the cytotoxic synergy with the DNA minor groove crosslinking agent SJG-136 (NSC 694501) in chronic lymphocytic leukaemia cells," Br. J. Cancer (2007) 97(2):253-259.
Pepper, C.J. et al., "The novel sequence-specific DNA cross-linking agent SJG-136 (NSC 694501) has potent and selective in vitro cytotoxicity in human B-cell chronic lymphocytic leukemia cells with evidence of a p53-independent mechanism of cell kill," Cancer Res. (2004) 64:6750-6755.
Puzanov, I., "Phase I and pharmacokinetic trial of SJG-136 administered on a daily x5 schedule," EJC Supplements (Nov. 2006) 4(12):93.
Quintas-Cardama, A., "Sequencing of subcloned PCR products facilitates earlier detetction of BCR-ABL1 and other mutants compared to direct sequencing of the ABL1 kinase domain," Leukemia (2008) 22(4):877-878.
Rahman, K.M., "Effect of microwave irradiation on covalent ligand-DNA interactions," Chem. Commun. (Cambridge, UK), Apr. 2009, 20:2875-2877.
Rahman, K.M., "Rules of DNA adduct formation for pyrrolobenzodiazepine (PBD) dimers," Proceedings of the American Association for Cancer Research Annual Meeting (Apr. 2010) 51:851.
Rahman, K.M., "The pyrrolobenzodiazepine dimer SJG-136 forms sequence-dependent intrastrand DNA cross-lins and monoalkylated adducts in addition to interstrand cross-links," J. Am. Chem. Soc., Sep. 2009, 131(38):13756-13766.
Reid, J.M., "LC-MS/MS assay and rat pharmacokinetics and metabolism of the dimeric pyrrolobenzodiazepine SJG-136," Proceedings of the American Association for Cancer Research Annual Meeting (Mar. 2004) 45:1248.
Rich, I.N., "Validation and development of a predictive paradigm for hemotoxicology using a multifunctional bioluminescence colony-forming proliferation assay," Toxicological Sci. (2005) 87(2):427-441.
Sagnou, M.J. et al., "Design and Synthesis of Novel Pyrrolobenzodiazepine (PDB) Prodrugs for ADEPT and GDEPT," Bioorganic & Medicinal Chemistry Letters, 10, 2083-2086 (2000).
Sanderson et al., "In vivo Drug-Linker Stability of an Anti-CD30 Dipeptide-Linked Auristatin Immunoconjugate," (2005) Clin. Cancer Res. 11:843-852.
Schweikart, K., "In vitro myelosuppression of SJG-136, a pyrrolobenzodiazepine dimer: comparison to bizelesin," Proceedings of the American Association for Cancer Research Annual Meeting (Mar. 2004) 45:486.
Shimizu et al., "Prothracarcin, a novel antitumor antibiotic," The Journal of Antibiotics (1982) 29, 2492-2503.
Shimizu, K et al., "Prothracarcin, a Novel Antitumor Antibiotic," J. Antibiotics, 35, 972-978 (1982).
Smellie, M. et al., "Cellular pharmacology of novel C8-linked anthramycin-based sequence-selective DNA minor groove cross-linking agents," Br. J. Cancer (1994) 70:48-53.
Smellie, M. et al., "Sequence selective recognition of duplex DNA through covalent interstrand cross-linking," Biochem. (2003) 42:8232-8239.
Souillac, P. et al., "Chracterization of delivery systems, differential scanning calorimetry," Encyclopedia of Controlled Drug Delivery (1999) 212-227 (pp. 217-218).
Suggitt, M., "The hollow fibre model—facilitating anti-cancer pre-clinical pharmacodynamics and improving animal welfare," Int. J. Oncol. (2006) 29(6):1493-1499.
Suggs, J.W. et al., "Synthesis and structure of anthramycin analogs via hydride reduction of dilactams," Tetrahedron Letters, 26, No. 40, 4871-4874 (1985).
Sutherland, M.S.K. et al., "SGN-CD33A: a novel CD33-directed antibody-drug conjugate, utilizing pyrrolobenzodiazepine dimers, demonstrates preclinical anti-tumor activity against multi-drug resistant human AML," American Society of Hematology (Dec. 8-12, 2012) Atlanta, Georgia, Abstract No. 3589.
Syrigos and Epenetos, "Antibody Directed Enzyme Prodrug Therapy (ADEPT): A Review of the Experimental and Clinical Considerations," (1999) Anticancer Research 19:605-614.
Takeuchi, T. et al., "Neothramycins A and B, New Antitumor Antibiotics," J. Antibiotics, 29, 93-96 (1976).
Tercel, M. et al., "Unsymmetrical DNA cross-linking agents: combination of the CBI and PBD pharmacophores," J. Med. Chem. (2003) 46:2132-2151.
Thurston, D. E., "Advances in the study of Pyrrolo [2,1-c][1,4] benzodiazepine (PBD) Antitumour Antibiotics", Molecular Aspects of Anticancer Drug-DNA Interaction, Neidle, S. and Waring, M.J., Eds.; Macmillan Press Ltd, 1:54-88 (1993).
Thurston, D.E. and Bose, D.S., "Synthesis of DNA-Interactive Pyrrolo [2,1-c][1,4]benzodiazepines," Chem. Rev., 94:433-465 (1994).
Thurston, D.E. and Thompson, A.S., "The molecular recognition of DNA," Chem. Brit., 26, 767-772 (1990).
Thurston, D.E. et al., "Effect of A-ring modifications on the DNA-binding behavior and cytotoxicity of pyrrolo [2,1-c][1,4]benzodiazepines", Journal of Medicinal Chemistry, 42:1951-1964 (1999).
Thurston, D.E. et al., "Synthesis of Sequence-selective C8-linked Pyrrolo [2,1-c][1,4] Benzodiazepine DNA Interstrand Cross-linking Agent," J. Org. Chem., 61:8141-8147 (1996).
Thurston, D.E. et al., "Synthesis of a novel GC-specific covalent-binding DNA affinity-cleavage agent based on pyrrolobenzodiazepines (PBDs)," Chemical Communications, 563-565 (1996).

(56) References Cited

OTHER PUBLICATIONS

Thurston, D.E., "Nucleic acid targeting: therapeutic strategies for the 21st century," Brit. J. Cancer (1999) 80(1):65-85.

Tiberghien, A.C. et al., "Application of the stille coupling reaction to the synthesis of C2-substituted endo-exo unsaturated pyrrolo [2,1-c][1,4]benzodiazepines (PBDs)," Biorg. Med. Chem. Lett. (2004) 14:5041-5044.

Tiberghien, A.C., "Application of the stille coupling reaction to the synthesis of C2-substituted endo-exo unsaturated pyrrolo [2,1-c][1,4]benzodiazepines (PBDs)," Bioorg. Med. Chem. Lett. (2008) 18(6):2073-2077.

Tozuka et al., "Studies on tomaymycin. II. Total synthesis of the antitumor antibiotics, E- and Z-tomaymycins," J. Antibiotics (Tokyo) (1983) 36:276-282.

Tsunakawa, M. et al., "Porothramycin, a new antibiotic of the anthramycin group: Production, isolation, structure and biological activity," J. Antibiotics, 41:1366-1373 (1988).

Umezawa, H. et al., "Mazethramycins," SciFinder Scholar, 2-3 (2002).

Umezawa, H. et al., Chemical Abstract No. 4427a, "Mazethramycins" Chemical Abstracts, vol. 90, No. 1, 428 (1979).

Vippagunta, S.R. et al., "Crystalline solids," Adv. Drug Delivery Rev. (2001) 48:3-26.

Wang, J.H., "Determination of antitumor agent AJG-136 in human serum by HPLC with tandem mass spectrometric detection (HPLC-MS/MS)," Abstracts of Papers American Chemical Society (Mar. 13, 2005) 229(1):U119.

Weidner-Wells, M.A. et al., "Photochemical approach to the synthesis of the pyrrolo[1,4]benzodiazepine antibiotics," J. Org. Chem. (1989) 54:5746-5758.

Wells, G. et al., "Design, synthesis and biophysical and biological evaluation of a series of pyrrolobenzodiazepine-poly(N-methylpyrrole) conjugates," J. Med. Chem. (2006) 49:5442-5461.

Wilkinson, G.P., "Pharmacokinetics and intracellular pharmacological characteristics of the novel pyrrolobenzodiazepine (PBD) dimer SJG-136," Proceedings of the American Association for Cancer Research Annual Meeting (Jul. 2003) 44:320.

Wilkinson, G.P., "Pharmacokinetics, metabolism and glutathione reactivity of SJG-136," Br. J. Cancer (2003) 88(Supp. 1):S29.

Wilkinson, G.P., "Preliminary pharmacokinetic and bioanalytical studies of SJG-136 (NSC 694501), a sequence-selective pyrrolobenzodiazepine dimer DNA-cross-linking agent," Investigational New Drugs (2004) 22(3):231-240.

Wilson, S.C. et al., "Design and Synthesis of a Novel Epoxide-Containing Pyrrolo [2,1-c][1,4]benzodiazepine (PBD) via a New Cyclization Procedure," Tetrahedron Letters, 36, No. 35, 6333-6336 (1995).

Wilson, S.C. et al., "Design, Synthesis, and Evaluation of a Novel Sequence-Selective Epoxide-Containing DNA Cross-Linking Agent Based on the Pyrrolo [2,1-c][1,4]benzodiazepine System", J. Med. Chem. 42:4028-4041 (1999).

Wolff, M.E., Burger's Medicinal Chemistry, 4th Edition, Part I, Wiley: New York (1979) 336-337.

Wolff, M.E., Burger's Medicinal Chemistry, 5th Edition, Part I, John Wiley & Sons (1995) 975-977.

Workman, P. et al., "United Kingdom Co-ordinating Committee on Cancer Research (UKCCCR) guidelines for the welfare of animals in experimental neoplasia (second edition)," Br. J. Cancer (1998) 77(1):1-10.

Xie, G. et al., "Bisindolylmaleimides linked to DNA minor groove binding lexitropsins: synthesis, inhibitory activity against topoisomerasel, and biological evaluation," J. Med. Chem. (1996) 39:1049-1055.

International Search Report and Written Opinion for Application No. PCT/EP2014/071791 dated Feb. 10, 2015 (8 pages).

PYRROLOBENZODIAZEPINES AND CONJUGATES THEREOF

The present invention relates to pyrrolobenzodiazepines (PBDs), in particular pyrrolobenzodiazepines having a labile C2 protecting group, in the form of a linker to a cell binding agent.

BACKGROUND TO THE INVENTION

Pyrrolobenzodiazepines

Some pyrrolobenzodiazepines (PBDs) have the ability to recognise and bond to specific sequences of DNA; the preferred sequence is PuGPu. The first PBD antitumour antibiotic, anthramycin, was discovered in 1965 (Leimgruber, et al., *J. Am. Chem. Soc.*, 87, 5793-5795 (1965); Leimgruber, et al., *J. Am. Chem. Soc.*, 87, 5791-5793 (1965)). Since then, a number of naturally occurring PBDs have been reported, and over 10 synthetic routes have been developed to a variety of analogues (Thurston, et al., *Chem. Rev.* 1994, 433-465 (1994); Antonow, D. and Thurston, D. E., *Chem. Rev.* 2011 111 (4), 2815-2864). Family members include abbeymycin (Hochlowski, et al., *J. Antibiotics*, 40, 145-148 (1987)), chicamycin (Konishi, et al., *J. Antibiotics*, 37, 200-206 (1984)), DC-81 (Japanese Patent 58-180 487; Thurston, et al., *Chem. Brit.*, 26, 767-772 (1990); Bose, et al., *Tetrahedron*, 48, 751-758 (1992)), mazethramycin (Kuminoto, et al., *J. Antibiotics*, 33, 665-667 (1980)), neothramycins A and B (Takeuchi, et al., *J. Antibiotics*, 29, 93-96 (1976)), porothramycin (Tsunakawa, et al., *J. Antibiotics*, 41, 1366-1373 (1988)), prothracarcin (Shimizu, et al, *J. Antibiotics*, 29, 2492-2503 (1982); Langley and Thurston, *J. Org. Chem.*, 52, 91-97 (1987)), sibanomicin (DC-102) (Hara, et al., *J. Antibiotics*, 41, 702-704 (1988); Itoh, et al., *J. Antibiotics*, 41, 1281-1284 (1988)), sibiromycin (Leber, et al., *J. Am. Chem. Soc.*, 110, 2992-2993 (1988)) and tomamycin (Arima, et al., *J. Antibiotics*, 25, 437-444 (1972)). PBDs are of the general structure:

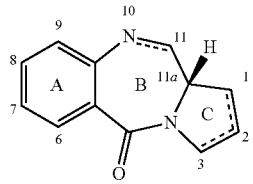

They differ in the number, type and position of substituents, in both their aromatic A rings and pyrrolo C rings, and in the degree of saturation of the C ring. In the B-ring there is either an imine (N=C), a carbinolamine(NH—CH(OH)), or a carbinolamine methyl ether (NH—CH(OMe)) at the N10-C11 position which is the electrophilic centre responsible for alkylating DNA. All of the known natural products have an (S)-configuration at the chiral C11a position which provides them with a right-handed twist when viewed from the C ring towards the A ring. This gives them the appropriate three-dimensional shape for isohelicity with the minor groove of B-form DNA, leading to a snug fit at the binding site (Kohn, In *Antibiotics III*. Springer-Verlag, New York, pp. 3-11 (1975); Hurley and Needham-VanDevanter, *Acc. Chem. Res.*, 19, 230-237 (1986)). Their ability to form an adduct in the minor groove, enables them to interfere with DNA processing, hence their use as antitumour agents.

A particularly advantageous pyrrolobenzodiazepine compound is described by Gregson et al. (*Chem. Commun.* 1999, 797-798) as compound 1, and by Gregson et al. (*J. Med. Chem.* 2001, 44, 1161-1174) as compound 4a. This compound, also known as SG2000, is shown below:

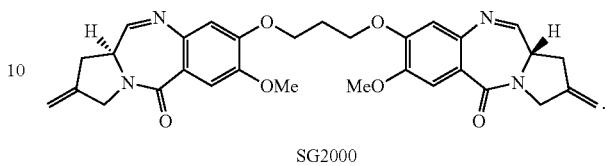

SG2000

WO 2007/085930 describes the preparation of dimer PBD compounds having linker groups for connection to a cell binding agent, such as an antibody. The linker is present in the bridge linking the monomer PBD units of the dimer.

Dimer PBD compounds having linker groups for connection to a cell binding agent, such as an antibody, are described in WO 2011/130613 and WO 2011/130616. The linker in these compounds is attached to the PBD core via the C2 position, and are generally cleaved by action of an enzyme on the linker group.

Antibody-Drug Conjugates

Antibody therapy has been established for the targeted treatment of patients with cancer, immunological and angiogenic disorders (Carter, P. (2006) Nature Reviews Immunology 6:343-357). The use of antibody-drug conjugates (ADC), i.e. immunoconjugates, for the local delivery of cytotoxic or cytostatic agents, i.e. drugs to kill or inhibit tumor cells in the treatment of cancer, targets delivery of the drug moiety to tumors, and intracellular accumulation therein, whereas systemic administration of these unconjugated drug agents may result in unacceptable levels of toxicity to normal cells (Xie et al (2006) *Expert. Opin. Biol. Ther.* 6(3):281-291; Kovtun et al (2006) *Cancer Res.* 66(6): 3214-3121; Law et al (2006) *Cancer Res.* 66(4):2328-2337; Wu et al (2005) *Nature Biotech.* 23(9):1137-1145; Lambert J. (2005) *Current Opin. in Pharmacol.* 5:543-549; Hamann P. (2005) *Expert Opin. Ther. Patents* 15(9):1087-1103; Payne, G. (2003) *Cancer Cell* 3:207-212; Trail et al (2003) *Cancer Immunol. Immunother.* 52:328-337; Syrigos and Epenetos (1999) *Anticancer Research* 19:605-614).

Maximal efficacy with minimal toxicity is sought thereby. Efforts to design and refine ADC have focused on the selectivity of monoclonal antibodies (mAbs) as well as drug mechanism of action, drug-linking, drug/antibody ratio (loading), and drug-releasing properties (Junutula, et al., 2008b Nature Biotech., 26(8):925-932; Dornan et al (2009) *Blood* 114(13):2721-2729; U.S. Pat. No. 7,521,541; U.S. Pat. No. 7,723,485; WO2009/052249; McDonagh (2006) Protein Eng. Design & Sel. 19(7): 299-307; Doronina et al (2006) Bioconj. Chem. 17:114-124; Erickson et al (2006) *Cancer Res.* 66(8):1-8; Sanderson et al (2005) *Clin. Cancer Res.* 11:843-852; Jeffrey et al (2005) *J. Med. Chem.* 48:1344-1358; Hamblett et al (2004) *Clin. Cancer Res.* 10:7063-7070). Drug moieties may impart their cytotoxic and cytostatic effects by mechanisms including tubulin binding, DNA binding, proteasome and/or topoisomerase inhibition. Some cytotoxic drugs tend to be inactive or less active when conjugated to large antibodies or protein receptor ligands.

The present inventors have developed particular PBD dimers with linking groups for the formation of PBD conjugates with cell binding agents, and in particular PBD antibody conjugates.

SUMMARY OF THE INVENTION

In a first aspect, the present invention provides a compound which is selected from A:

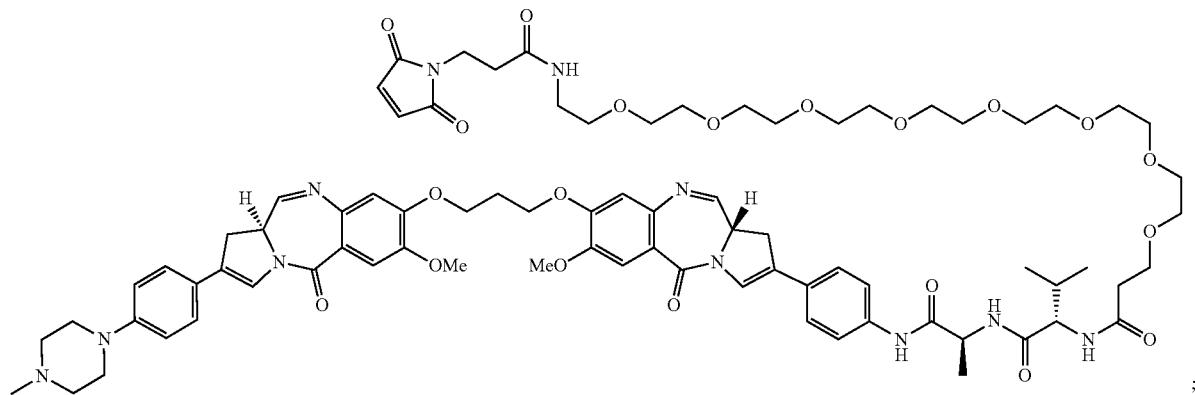

A, 20 and
B:

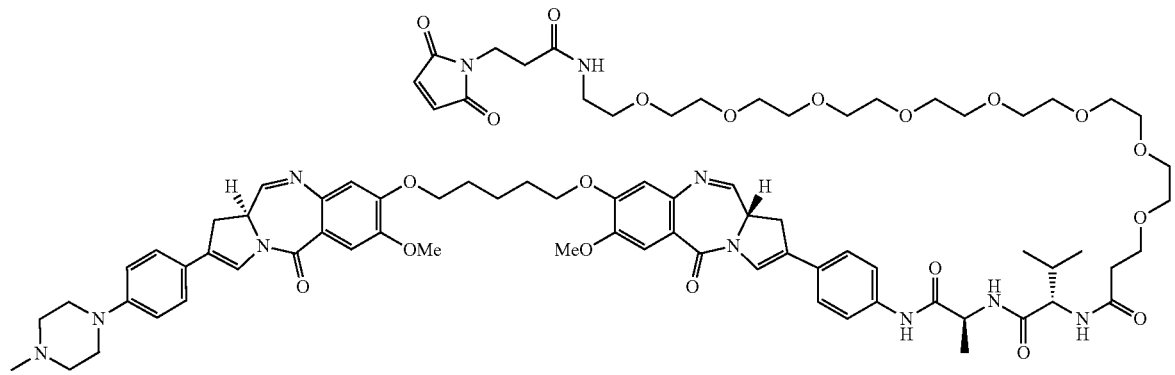

B, 26 and salts and solvates thereof.

WO 2010/043380 and WO 2011/130613 disclose compound 30:

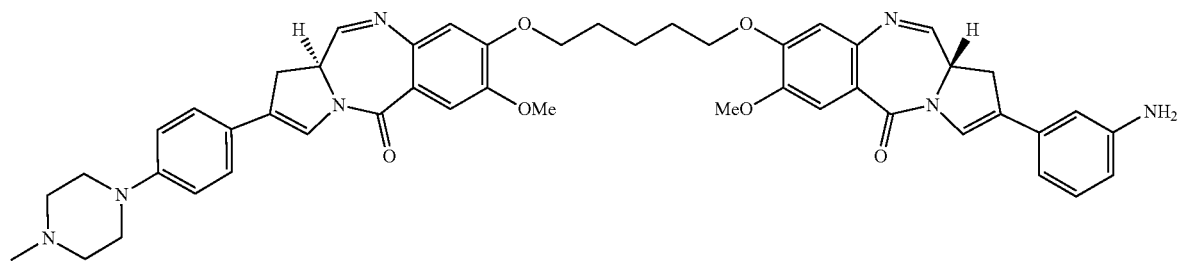

30

WO 2011/130613 also discloses compound 51:

Compound A differs from compound 30 by only having a (CH$_2$)$_3$ tether between the PBD moieties, instead of a (CH$_2$)$_5$ tether, which reduces the lipophilicity of the released PBD dimer. The linking group in both Compounds A and B is attached to the C2-phenyl group in the para rather than meta position.

Compounds A and B have two sp$^2$ centres in each C-ring, which may allow for stronger binding in the minor groove of DNA, than for compounds with only one sp$^2$ centre in each C-ring.

A second aspect of the present invention provides a conjugate of formula ConjA:

where CBA represents a cell binding agent. The link to the moiety shown is via a free S (active thiol) on the cell binding agent.

DETAILED DESCRIPTION OF THE INVENTION

The present invention provides a PBD dimer with a linker connected through the C2 position on one of the PBD moieties suitable for forming a PBD dimer conjugated via the linker to a cell binding agent.

or
ConjB:

The present invention is suitable for use in providing a PBD compound to a preferred site in a subject. The conjugate allows the release of an active PBD compound that does not retain any part of the linker. There is no stub present that could affect the reactivity of the PBD compound. Thus ConjA would release the compound RelA:

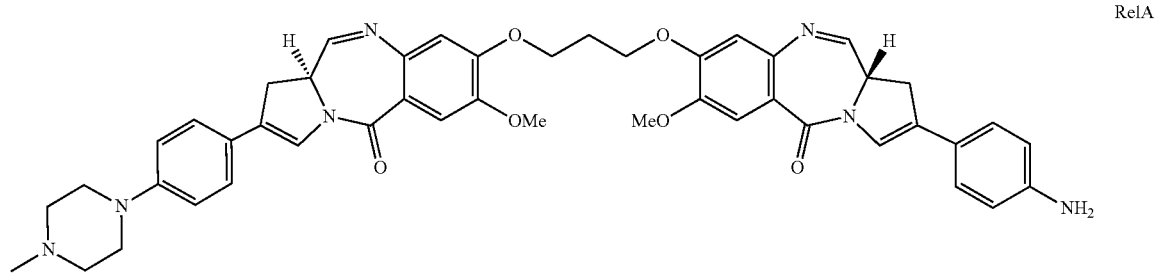 [SMILES: COc1cc2c(cc1OCCCOc1cc3c(cc1OC)C(=O)N1C=C(c4ccc(N5CCN(C)CC5)cc4)C[C@H]1C=N3)N=C[C@@H]1CC(c3ccc(N)cc3)=CN1C2=O]

RelA and
ConjB would release the compound RelB:

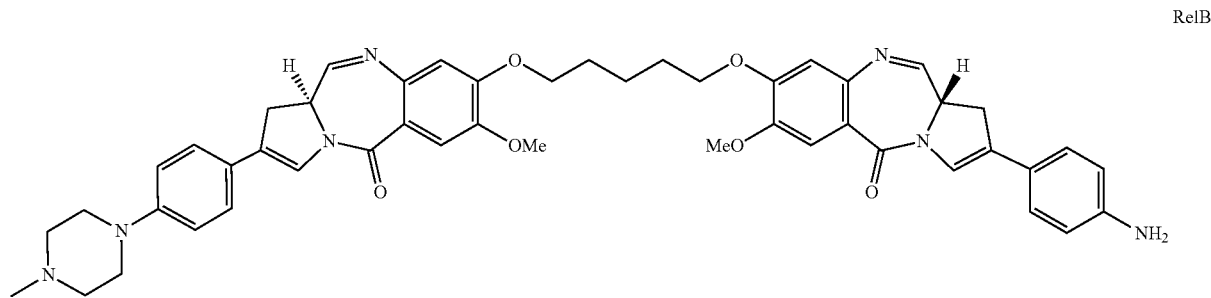 [SMILES: COc1cc2c(cc1OCCCCCOc1cc3c(cc1OC)C(=O)N1C=C(c4ccc(N5CCN(C)CC5)cc4)C[C@H]1C=N3)N=C[C@@H]1CC(c3ccc(N)cc3)=CN1C2=O]

RelB

A further aspect of the present invention is the compounds RelB, and salts and solvates thereof.

The specified link between the PBD dimer and the cell binding agent, e.g. antibody, in the present invention is preferably stable extracellularly. Before transport or delivery into a cell, the antibody-drug conjugate (ADC) is preferably stable and remains intact, i.e. the antibody remains linked to the drug moiety. The linkers are stable outside the target cell and may be cleaved at some efficacious rate inside the cell. An effective linker will: (i) maintain the specific binding properties of the antibody; (ii) allow intracellular delivery of the conjugate or drug moiety; (iii) remain stable and intact, i.e. not cleaved, until the conjugate has been delivered or transported to its targeted site; and (iv) maintain a cytotoxic, cell-killing effect or a cytostatic effect of the PBD drug moiety. Stability of the ADC may be measured by standard analytical techniques such as mass spectroscopy, HPLC, and the separation/analysis technique LC/MS.

Delivery of the compounds of formulae RelA or RelB is achieved at the desired activation site of the conjugates of formulae ConjA or ConjB by the action of an enzyme, such as cathepsin, on the linking group, and in particular on the valine-alanine dipeptide moiety.

Cell Binding Agent

A cell binding agent may be of any kind, and include peptides and non-peptides. These can include antibodies or a fragment of an antibody that contains at least one binding site, lymphokines, hormones, hormone mimetics, vitamins, growth factors, nutrient-transport molecules, or any other cell binding molecule or substance.

Peptides

In one embodiment, the cell binding agent is a linear or cyclic peptide comprising 4-30, preferably 6-20, contiguous amino acid residues. In this embodiment, it is preferred that one cell binding agent is linked to one monomer or dimer pyrrolobenzodiazepine compound. In one embodiment the cell binding agent comprises a peptide that binds integrin $\alpha_v\beta_6$. The peptide may be selective for $\alpha_v\beta_6$ over XYS.

In one embodiment the cell binding agent comprises the A20FMDV-Cys polypeptide. The A20FMDV-Cys has the sequence: NAVPNLRGDLQVLAQKVARTC. Alternatively, a variant of the A20FMDV-Cys sequence may be used wherein one, two, three, four, five, six, seven, eight, nine or ten amino acid residues are substituted with another amino acid residue. Furthermore, the polypeptide may have the sequence NAVXXXXXXXXXXXXXXXXRTC.

Antibodies

The term "antibody" herein is used in the broadest sense and specifically covers monoclonal antibodies, polyclonal antibodies, dimers, multimers, multispecific antibodies (e.g., bispecific antibodies), and antibody fragments, so long as they exhibit the desired biological activity (Miller et al (2003) *Jour. of Immunology* 170:4854-4861). Antibodies may be murine, human, humanized, chimeric, or derived from other species. An antibody is a protein generated by the immune system that is capable of recognizing and binding to a specific antigen. (Janeway, C., Travers, P., Walport, M., Shlomchik (2001) *Immuno Biology*, 5th Ed., Garland Publishing, New York). A target antigen generally has numerous binding sites, also called epitopes, recognized by CDRs on multiple antibodies. Each antibody that specifically binds to a different epitope has a different structure. Thus, one antigen may have more than one corresponding antibody. An antibody includes a full-length immunoglobulin molecule or an immunologically active portion of a full-length immunoglobulin molecule, i.e., a molecule that contains an antigen binding site that immunospecifically binds an antigen of a target of interest or part thereof, such targets including but not limited to, cancer cell or cells that produce autoimmune antibodies associated with an autoimmune disease. The immunoglobulin can be of any type (e.g. IgG, IgE, IgM, IgD, and IgA), class (e.g. IgG1, IgG2, IgG3, IgG4, IgA1 and IgA2) or subclass of immunoglobulin molecule. The immunoglobulins can be derived from any species, including human, murine, or rabbit origin.

"Antibody fragments" comprise a portion of a full length antibody, generally the antigen binding or variable region thereof. Examples of antibody fragments include Fab, Fab', F(ab')$_2$, and scFv fragments; diabodies; linear antibodies; fragments produced by a Fab expression library, anti-idiotypic (anti-Id) antibodies, CDR (complementary determining region), and epitope-binding fragments of any of the above which immunospecifically bind to cancer cell antigens, viral antigens or microbial antigens, single-chain antibody molecules; and multispecific antibodies formed from antibody fragments.

The term "monoclonal antibody" as used herein refers to an antibody obtained from a population of substantially homogeneous antibodies, i.e. the individual antibodies comprising the population are identical except for possible naturally occurring mutations that may be present in minor amounts. Monoclonal antibodies are highly specific, being directed against a single antigenic site. Furthermore, in contrast to polyclonal antibody preparations which include different antibodies directed against different determinants (epitopes), each monoclonal antibody is directed against a single determinant on the antigen. In addition to their specificity, the monoclonal antibodies are advantageous in that they may be synthesized uncontaminated by other antibodies. The modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by the hybridoma method first described by Kohler et al (1975) *Nature* 256:495, or may be made by recombinant DNA methods (see, U.S. Pat. No. 4,816,567). The monoclonal antibodies may also be isolated from phage antibody libraries using the techniques described in Clackson et al (1991) Nature, 352:624-628; Marks et al (1991) J. Mol. Biol., 222:581-597 or from transgenic mice carrying a fully human immunoglobulin system (Lonberg (2008) Curr. Opinion 20(4):450-459).

The monoclonal antibodies herein specifically include "chimeric" antibodies in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies, so long as they exhibit the desired biological activity (U.S. Pat. No. 4,816,567; and Morrison et al (1984) *Proc. Natl. Acad. Sci. USA*, 81:6851-6855). Chimeric antibodies include "primatized" antibodies comprising variable domain antigen-binding sequences derived from a non-human primate (e.g. Old World Monkey or Ape) and human constant region sequences.

An "intact antibody" herein is one comprising a VL and VH domains, as well as a light chain constant domain (CL) and heavy chain constant domains, CH1, CH2 and CH3. The constant domains may be native sequence constant domains (e.g. human native sequence constant domains) or amino acid sequence variant thereof. The intact antibody may have one or more "effector functions" which refer to those biological activities attributable to the Fc region (a native sequence Fc region or amino acid sequence variant Fc region) of an antibody. Examples of antibody effector functions include C1q binding; complement dependent cytotoxicity; Fc receptor binding; antibody-dependent cell-mediated cytotoxicity (ADCC); phagocytosis; and down regulation of cell surface receptors such as B cell receptor and BCR.

Depending on the amino acid sequence of the constant domain of their heavy chains, intact antibodies can be assigned to different "classes." There are five major classes of intact antibodies: IgA, IgD, IgE, IgG, and IgM, and several of these may be further divided into "subclasses" (isotypes), e.g., IgG1, IgG2, IgG3, IgG4, IgA, and IgA2. The heavy-chain constant domains that correspond to the different classes of antibodies are called α, δ, ε, γ, and μ, respectively. The subunit structures and three-dimensional configurations of different classes of immunoglobulins are well known.

Humanisation

Techniques to reduce the in vivo immunogenicity of a non-human antibody or antibody fragment include those termed "humanisation".

A "humanized antibody" refers to a polypeptide comprising at least a portion of a modified variable region of a human antibody wherein a portion of the variable region, preferably a portion substantially less than the intact human variable domain, has been substituted by the corresponding sequence from a non-human species and wherein the modified variable region is linked to at least another part of another protein, preferably the constant region of a human antibody. The expression "humanized antibodies" includes human antibodies in which one or more complementarity determining region ("CDR") amino acid residues and/or one or more framework region ("FW" or "FR") amino acid residues are substituted by amino acid residues from analogous sites in rodent or other non-human antibodies. The expression "humanized antibody" also includes an immunoglobulin amino acid sequence variant or fragment thereof that comprises an FR having substantially the amino acid sequence of a human immunoglobulin and a CDR having substantially the amino acid sequence of a non-human immunoglobulin.

"Humanized" forms of non-human (e.g., murine) antibodies are chimeric antibodies that contain minimal sequence derived from non-human immunoglobulin. Or, looked at another way, a humanized antibody is a human antibody that also contains selected sequences from non-human (e.g. murine) antibodies in place of the human sequences. A humanized antibody can include conservative amino acid substitutions or non-natural residues from the same or different species that do not significantly alter its binding and/or biologic activity. Such antibodies are chimeric antibodies that contain minimal sequence derived from non-human immunoglobulins.

There are a range of humanisation techniques, including 'CDR grafting', 'guided selection', 'deimmunization', 'resurfacing' (also known as 'veneering'), 'composite antibodies', 'Human String Content Optimisation' and framework shuffling.

CDR Grafting

In this technique, the humanized antibodies are human immunoglobulins (recipient antibody) in which residues from a complementary-determining region (CDR) of the recipient antibody are replaced by residues from a CDR of a non-human species (donor antibody) such as mouse, rat, camel, bovine, goat, or rabbit having the desired properties (in effect, the non-human CDRs are 'grafted' onto the human framework). In some instances, framework region (FR) residues of the human immunoglobulin are replaced by corresponding non-human residues (this may happen when, for example, a particular FR residue has significant effect on antigen binding).

Furthermore, humanized antibodies can comprise residues that are found neither in the recipient antibody nor in the imported CDR or framework sequences. These modifications are made to further refine and maximize antibody performance. Thus, in general, a humanized antibody will comprise all of at least one, and in one aspect two, variable domains, in which all or all of the hypervariable loops correspond to those of a non-human immunoglobulin and all or substantially all of the FR regions are those of a human immunoglobulin sequence. The humanized antibody optionally also will comprise at least a portion of an immunoglobulin constant region (Fc), or that of a human immunoglobulin.

Guided Selection

The method consists of combining the $V_H$ or $V_L$ domain of a given non-human antibody specific for a particular epitope with a human $V_H$ or $V_L$ library and specific human V domains are selected against the antigen of interest. This selected human VH is then combined with a VL library to generate a completely human VH×VL combination. The method is described in Nature Biotechnology (N.Y.) 12, (1994) 899-903.

Composite Antibodies

In this method, two or more segments of amino acid sequence from a human antibody are combined within the final antibody molecule. They are constructed by combining multiple human VH and VL sequence segments in combinations which limit or avoid human T cell epitopes in the final composite antibody V regions. Where required, T cell epitopes are limited or avoided by, exchanging V region segments contributing to or encoding a T cell epitope with alternative segments which avoid T cell epitopes. This method is described in US 2008/0206239 A1.

Deimmunization

This method involves the removal of human (or other second species) T-cell epitopes from the V regions of the therapeutic antibody (or other molecule). The therapeutic antibodies V-region sequence is analysed for the presence of MHC class II-binding motifs by, for example, comparison with databases of MHC-binding motifs (such as the "motifs" database hosted at www.wehi.edu.au). Alternatively, MHC class II-binding motifs may be identified using computational threading methods such as those devised by Altuvia et al. (J. Mol. Biol. 249 244-250 (1995)); in these methods, consecutive overlapping peptides from the V-region sequences are testing for their binding energies to MHC class II proteins. This data can then be combined with information on other sequence features which relate to successfully presented peptides, such as amphipathicity, Rothbard motifs, and cleavage sites for cathepsin B and other processing enzymes.

Once potential second species (e.g. human) T-cell epitopes have been identified, they are eliminated by the alteration of one or more amino acids. The modified amino acids are usually within the T-cell epitope itself, but may also be adjacent to the epitope in terms of the primary or secondary structure of the protein (and therefore, may not be adjacent in the primary structure). Most typically, the alteration is by way of substitution but, in some circumstances amino acid addition or deletion will be more appropriate.

All alterations can be accomplished by recombinant DNA technology, so that the final molecule may be prepared by expression from a recombinant host using well established methods such as Site Directed Mutagenesis. However, the use of protein chemistry or any other means of molecular alteration is also possible.

Resurfacing

This method involves:
(a) determining the conformational structure of the variable region of the non-human (e.g. rodent) antibody (or fragment thereof) by constructing a three-dimensional model of the non-human antibody variable region;
(b) generating sequence alignments using relative accessibility distributions from x-ray crystallographic structures of a sufficient number of non-human and human antibody variable region heavy and light chains to give a set of heavy and light chain framework positions wherein the alignment positions are identical in 98% of the sufficient number of non-human antibody heavy and light chains;
(c) defining for the non-human antibody to be humanized, a set of heavy and light chain surface exposed amino acid residues using the set of framework positions generated in step (b);
(d) identifying from human antibody amino acid sequences a set of heavy and light chain surface exposed amino acid residues that is most closely identical to the set of surface exposed amino acid residues defined in step (c), wherein the heavy and light chain from the human antibody are or are not naturally paired;
(e) substituting, in the amino acid sequence of the non-human antibody to be humanized, the set of heavy and light chain surface exposed amino acid residues defined in step (c) with the set of heavy and light chain surface exposed amino acid residues identified in step (d);
(f) constructing a three-dimensional model of the variable region of the non-human antibody resulting from the substituting specified in step (e);
(g) identifying, by comparing the three-dimensional models constructed in steps (a) and (f), any amino acid residues from the sets identified in steps (c) or (d), that are within 5 Angstroms of any atom of any residue of the complementarity determining regions of the non-human antibody to be humanized; and
(h) changing any residues identified in step (g) from the human to the original non-human amino acid residue to thereby define a non-human antibody humanizing set of surface exposed amino acid residues; with the proviso that step (a) need not be conducted first, but must be conducted prior to step (g).

Superhumanization

The method compares the non-human sequence with the functional human germline gene repertoire. Those human genes encoding canonical structures identical or closely related to the non-human sequences are selected. Those selected human genes with highest homology within the CDRs are chosen as FR donors. Finally, the non-human CDRs are grafted onto these human FRs. This method is described in patent WO 2005/079479 A2.

Human String Content Optimization

This method compares the non-human (e.g. mouse) sequence with the repertoire of human germline genes and the differences are scored as Human String Content (HSC) that quantifies a sequence at the level of potential MHC/T- cell epitopes. The target sequence is then humanized by maximizing its HSC rather than using a global identity measure to generate multiple diverse humanized variants (described in Molecular Immunology, 44, (2007) 1986-1998).

Framework Shuffling

The CDRs of the non-human antibody are fused in-frame to cDNA pools encompassing all known heavy and light chain human germline gene frameworks. Humanised antibodies are then selected by e.g. panning of the phage displayed antibody library. This is described in *Methods* 36, 43-60 (2005).

Examples of cell binding agents include those agents described for use in WO 2007/085930, which is incorporated herein.

Tumour-associate antigens and cognate antibodies for use in embodiments of the present invention are listed below.

Tumor-Associated Antigens and Cognate Antibodies (1) BMPRIB (Bone Morphogenetic Protein Receptor-Type IB)

Nucleotide

Genbank accession no. NM_001203
Genbank version no. NM_001203.2 GI:169790809
Genbank record update date: Sep. 23, 2012 02:06 PM
Polypeptide
Genbank accession no. NP_001194
Genbank version no. NP_001194.1 GI:4502431
Genbank record update date: Sep. 23, 2012 02:06 PM
Cross-References
ten Dijke, P., et al *Science* 264 (5155): 101-104 (1994), *Oncogene* 14 10 (11):1377-1382 (1997)); WO2004/063362 (claim 2); WO2003/042661 (claim 12);
US2003/134790-A1 (Page 38-39); WO2002/102235 (claim 13; Page 296); WO2003/055443 (Page 91-92); WO2002/99122 (Example 2; Page 528-530); WO2003/029421 (claim 6); WO2003/024392 (claim 2; FIG. 112); WO2002/98358 (claim 1; Page 183); WO2002/54940 (Page 100-101); WO2002/59377 (Page 349-350); WO2002/30268 (claim 27; Page 376); 15 WO2001/48204 (Example; FIG. 4); NP_001194 bone morphogenetic protein receptor, type IB/pid=NP_001194.1.; MIM:603248; AY065994

(2) E16 (LAT1, SLC7A5)

Nucleotide

Genbank accession no. NM_003486
Genbank version no. NM_003486.5 GI:71979931
Genbank record update date: Jun. 27, 2012 12:06 PM
Polypeptide
Genbank accession no. NP_003477
Genbank version no. NP_003477.4 GI:71979932
Genbank record update date: Jun. 27, 2012 12:06 PM
Cross References
*Biochem. Biophys. Res.*
*Commun.* 255 (2), 283-288 (1999), *Nature* 395 (6699): 288-291 (1998), Gaugitsch, H. W., et 20 al (1992) *J. Biol. Chem.* 267 (16):11267-11273); WO2004/048938 (Example 2); WO2004/032842 (Example IV); WO2003/042661 (claim 12); WO2003/016475 (claim 1); WO2002/78524 (Example 2); WO2002/99074 (claim 19; Page 127-129); WO2002/86443 (claim 27; Pages 222, 393); WO2003/003906 (claim 10; Page 293); WO2002/64798 (claim 33; Page 93-95); WO2000/14228 (claim 5; Page 133-136); US2003/224454 (FIG. 3); 25 WO2003/025138 (claim 12; Page 150); NP_003477 solute carrier family 7 (cationic amino acid transporter, y+system), member 5/pid=NP_003477.3-*Homo sapiens*; MIM:600182; NM_015923.

(3) STEAP1 (Six Transmembrane Epithelial Antigen of Prostate)

Nucleotide

Genbank accession no. NM_012449
Genbank version no. NM_012449.2 GI:22027487
Genbank record update date: Sep. 9, 2012 02:57 PM
Polypeptide
Genbank accession no. NP_036581
Genbank version no. NP_036581.1 GI:9558759
Genbank record update date: Sep. 9, 2012 02:57 PM
Cross References
*Cancer Res.* 61 (15), 5857-5860 (2001), Hubert, R. S., et al (1999) *Proc. Natl. Acad. Sci. U.S.A.* 96 (25):14523-14528); WO2004/065577 (claim 6); WO2004/027049 (FIG. 1L); EP1394274 (Example 11); WO2004/016225 (claim 2); WO2003/042661 (claim 12); US2003/157089 (Example 5); US2003/185830 (Example 5); US2003/064397 (FIG. 2); WO2002/89747 (Example 5; Page 618-619); WO2003/022995 (Example 9; FIG. 13A, 35 Example 53; Page 173, Example 2; FIG. 2A); six transmembrane epithelial antigen of the prostate; MIM:604415.

(4) 0772P (CA125, MUC16)

Nucleotide

Genbank accession no. AF361486
Genbank version no. AF361486.3 GI:34501466
Genbank record update date: Mar. 11, 2010 07:56 AM
Polypeptide
Genbank accession no. AAK74120
Genbank version no. AAK74120.3 GI:34501467
Genbank record update date: Mar. 11, 2010 07:56 AM
Cross References
*J. Biol. Chem.* 276 (29):27371-27375 (2001)); WO2004/045553 (claim 14); WO2002/92836 (claim 6; FIG. 12); WO2002/83866 (claim 15; Page 116-121); US2003/124140 (Example 16); GI:34501467;

(5) MPF (MPF, MSLN, SMR, Megakaryocyte Potentiating Factor, Mesothelin)

Nucleotide

Genbank accession no. NM_005823
Genbank version no. NM_005823.5 GI:293651528
Genbank record update date: Sep. 2, 2012 01:47 PM
Polypeptide
Genbank accession no. NP_005814
Genbank version no. NP_005814.2 GI:53988378
Genbank record update date: Sep. 2, 2012 01:47 PM
Cross References
Yamaguchi, N., et al *Biol. Chem.* 269 (2), 805-808 (1994), *Proc. Natl. Acad. Sci. U.S.A.* 96 (20):11531-11536 (1999), *Proc. Natl. Acad. Sci. U.S.A.* 93 10 (1):136-140 (1996), *J. Biol. Chem.* 270 (37):21984-21990 (1995)); WO2003/101283 (claim 14); (WO2002/102235 (claim 13; Page 287-288); WO2002/101075 (claim 4; Page 308-309); WO2002/71928 (Page 320-321); WO94/10312 (Page 52-57); IM:601051.

(6) Napi3b (NAPI-3B, NPTIIb, SLC34A2, Solute Carrier Family 34 (Sodium Phosphate), Member 2, Type II Sodium-Dependent Phosphate Transporter 3b)

Nucleotide

Genbank accession no. NM_006424
Genbank version no. NM_006424.2 GI:110611905
Genbank record update date: Jul. 22, 2012 03:39 PM
Polypeptide
Genbank accession no. NP_006415
Genbank version no. NP_006415.2 GI:110611906
Genbank record update date: Jul. 22, 2012 03:39 PM Cross References J. Biol. Chem. 277 (22):19665-19672 (2002), Genomics 62 (2):281-284 (1999), Feild, J. A., et al (1999) Biochem. Biophys. Res. Commun. 258 (3):578-582); WO2004/022778 (claim 2); EP1394274 (Example 11); WO2002/102235 (claim 13; Page 20 326); EP0875569 (claim 1; Page 17-19); WO2001/57188 (claim 20; Page 329); WO2004/032842 (Example IV); WO2001/75177 (claim 24; Page 139-140); MIM:604217.

(7) Sema 5b (FLJ10372, KIAA1445, Mm.42015, SEMA5B, SEMAG, Semaphorin 5b Hlog, 25 Sema Domain, Seven Thrombospondin Repeats (Type 1 and Type 1-Like), Transmembrane Domain (TM) and Short Cytoplasmic Domain, (Semaphorin) 58)
Nucleotide
Genbank accession no. AB040878
Genbank version no. AB040878.1 GI:7959148
Genbank record update date: Aug. 2, 2006 05:40 PM
Polypeptide
Genbank accession no. BAA95969
Genbank version no. BAA95969.1 GI:7959149
Genbank record update date: Aug. 2, 2006 05:40 PM
Cross References
Nagase T., et al (2000) DNA Res. 7 (2):143-150); WO2004/000997 (claim 1); WO2003/003984 (claim 1); WO2002/06339 (claim 1; Page 50); WO2001/88133 (claim 1; Page 41-43, 48-58); WO2003/054152 (claim 20); WO2003/101400 (claim 11); Accession: 30 Q9P283; Genew; HGNC:10737

(8) PSCA hlg (2700050C12Rik, C530008O16Rik, RIKEN cDNA 2700050C12, RIKEN cDNA 2700050C12 gene)
Nucleotide
Genbank accession no. AY358628
Genbank version no. AY358628.1 GI:37182377
Genbank record update date: Dec. 1, 2009 04:15 AM
Polypeptide
Genbank accession no. AAQ88991
Genbank version no. AAQ88991.1 GI:37182378
Genbank record update date: Dec. 1, 2009 04:15 AM
Cross References
Ross et al (2002) Cancer Res. 62:2546-2553; US2003/129192 (claim 2); US2004/044180 (claim 12); US2004/044179 35 (claim 11); US2003/096961 (claim 11); US2003/232056 (Example 5); WO2003/105758 16 (claim 12); US2003/206918 (Example 5); EP1347046 (claim 1); WO2003/025148 (claim 20); GI:37182378.

(9) ETBR (Endothelin Type B Receptor)
Nucleotide
Genbank accession no. AY275463
Genbank version no. AY275463.1 GI:30526094
Genbank record update date: Mar. 11, 2010 02:26 AM
Polypeptide
Genbank accession no. AAP32295
Genbank version no. AAP32295.1 GI:30526095
Genbank record update date: Mar. 11, 2010 02:26 AM
Cross References
Nakamuta M., et al Biochem. Biophys. Res. Commun. 177, 34-39, 1991; Ogawa Y., et al Biochem. Biophys. Res. Commun. 178, 248-255, 1991; Arai H., et al Jpn. Circ. J. 56, 1303-1307, 1992; Arai H., et al J. Biol. Chem. 268, 3463-3470, 1993; Sakamoto A., Yanagisawa M., et al Biochem. Biophys. Res. Commun. 178, 656-663, 1991; Elshourbagy N. A., et al J. Biol. Chem. 268, 3873-3879, 1993; Haendler B., et al J. Cardiovasc. Pharmacol. 20, s1-S4, 1992; Tsutsumi M., et al Gene 228, 43-49, 1999; Strausberg R. L., et al Proc. Natl. Acad. Sci. U.S.A. 99, 16899-16903, 2002; Bourgeois C., et al J. Clin. Endocrinol. Metab. 82, 3116-3123, 1997;

Okamoto Y., et al Biol. Chem. 272, 21589-21596, 1997; Verheij J. B., et al Am. J. Med. Genet. 108, 223-225, 2002; Hofstra R. M. W., et al Eur. J. Hum. Genet. 5, 180-185, 1997; Puffenberger E. G., et al Cell 79, 1257-1266, 1994; Attie T., et al, Hum. Mol. Genet. 4, 2407-15 2409, 1995; Auricchio A., et al Hum. Mol. Genet. 5:351-354, 1996; Amiel J., et al Hum. Mol. Genet. 5, 355-357, 1996; Hofstra R. M. W., et al Nat. Genet. 12, 445-447, 1996; Svensson P. J., et al Hum. Genet. 103, 145-148, 1998; Fuchs S., et al Mol. Med. 7, 115-124, 2001; Pingault V., et al (2002) Hum. Genet. 111, 198-206; WO2004/045516 (claim 1); WO2004/048938 (Example 2); WO2004/040000 (claim 151); WO2003/087768 (claim 1); 20 WO2003/016475 (claim 1); WO2003/016475 (claim 1); WO2002/61087 (FIG. 1); WO2003/016494 (FIG. 6); WO2003/025138 (claim 12; Page 144); WO2001/98351 (claim 1; Page 124-125); EP0522868 (claim 8; FIG. 2); WO2001/77172 (claim 1; Page 297-299); US2003/109676; U.S. Pat. No. 6,518,404 (FIG. 3); U.S. Pat. No. 5,773,223 (Claim 1a; Col 31-34); WO2004/001004.

(10) MSG783 (RNF124, Hypothetical Protein FLJ20315)
Nucleotide
Genbank accession no. NM_017763
Genbank version no. NM_017763.4 GI:167830482
Genbank record update date: Jul. 22, 2012 12:34 AM
Polypeptide
Genbank accession no. NP_060233
Genbank version no. NP_060233.3 GI:56711322
Genbank record update date: Jul. 22, 2012 12:34 AM
Cross References
WO2003/104275 (claim 1); WO2004/046342 (Example 2); WO2003/042661 (claim 12); WO2003/083074 (claim 14; Page 61); WO2003/018621 (claim 1); WO2003/024392 (claim 2; FIG. 93); WO2001/66689 (Example 6); LocusID: 54894.

(11) STEAP2 (HGNC 8639, IPCA-1, PCANAPI, STAMPI, STEAP2, STMP, Prostate Cancer Associated Gene 1, Prostate Cancer Associated Protein 1, Six Transmembrane Epithelial Antigen of Prostate 2, Six Transmembrane Prostate Protein)
Nucleotide
Genbank accession no. AF455138
Genbank version no. AF455138.1 GI:22655487
Genbank record update date: Mar. 11, 2010 01:54 AM
Polypeptide
Genbank accession no. AAN04080
Genbank version no. AAN04080.1 GI:22655488
Genbank record update date: Mar. 11, 2010 01:54 AM
Cross References
Lab. Invest. 82 (11):1573-1582 (2002)); WO2003/087306; US2003/064397 (claim 1; FIG. 1); WO2002/72596 (claim 13; Page 54-55); WO2001/72962 (claim 1; FIG. 4B); 35 WO2003/104270 (claim 11); WO2003/104270 (claim 16); US2004/005598 (claim 22); WO2003/042661 (claim 12); US2003/060612 (claim 12; FIG. 10); WO2002/26822 (claim 23; FIG. 2); WO2002/16429 (claim 12; FIG. 10); GI:22655488.

(12) TrpM4 (BR22450, FLJ20041, TRPM4, TRPM4B, Transient Receptor Potential Cation 5 Channel, Subfamily M, Member 4)
Nucleotide
Genbank accession no. NM_017636
Genbank version no. NM_017636.3 GI:304766649
Genbank record update date: Jun. 29, 2012 11:27 AM Polypeptide
Genbank accession no. NP_060106
Genbank version no. NP_060106.2 GI:21314671
Genbank record update date: Jun. 29, 2012 11:27 AM
Cross References
Xu, X. Z., et al *Proc. Natl. Acad. Sci. U.S.A.* 98 (19): 10692-10697 (2001), *Cell* 109 (3):397-407 (2002), *J. Biol. Chem.* 278 (33):30813-30820 (2003)); US2003/143557 (claim 4); WO2000/40614 (claim 14; Page 100-103); WO2002/10382 (claim 1; FIG. 9A); WO2003/042661 (claim 12); WO2002/30268 (claim 27; Page 391); US2003/219806 (claim 4); WO2001/62794 (claim 10 14; FIG. 1A-D); MIM:606936.

(13) CRIPTO (CR, CR1, CRGF, CRIPTO, TDGF1, Teratocarcinoma-Derived Growth Factor)
Nucleotide
Genbank accession no. NM_003212
Genbank version no. NM_003212.3 GI:292494881
Genbank record update date: Sep. 23, 2012 02:27 PM
Polypeptide
Genbank accession no. NP_003203
Genbank version no. NP_003203.1 GI:4507425
Genbank record update date: Sep. 23, 2012 02:27 PM
Cross References
Ciccodicola, A., et al *EMBO J.* 8 (7):1987-1991 (1989), *Am. J. Hum. Genet.* 49 (3):555-565 (1991)); US2003/224411 (claim 1); WO2003/083041 (Example 1); WO2003/034984 (claim 12); WO2002/88170 (claim 2; Page 52-53); WO2003/024392 (claim 2; FIG. 58); WO2002/16413 (claim 1; Page 94-95, 105); WO2002/22808 (claim 2; FIG. 1); U.S. Pat. No. 5,854,399 (Example 2; Col 17-18); U.S. Pat. No. 5,792,616 (FIG. 2); MIM:187395.

(14) CD21 (CR2 (Complement receptor 2) or C3DR (C3d/Epstein Barr Virus Receptor) or Hs.73792)
Nucleotide
Genbank accession No M26004
Genbank version no. M26004.1 GI:181939
Genbank record update date: Jun. 23, 2010 08:47 AM
Polypeptide
Genbank accession no. AAA35786
Genbank version no. AAA35786.1 GI:181940
Genbank record update date: Jun. 23, 2010 08:47 AM
Cross References
Fujisaku et al (1989) *J. Biol. Chem.* 264 (4):2118-2125); Weis J. J., et al *J. Exp. Med.* 167, 1047-1066, 1988; Moore M., et al *Proc. Natl. Acad. Sci. U.S.A.* 84, 9194-9198, 1987; Barel M., et al *Mol. Immunol.* 35, 1025-1031, 1998; Weis J. J., et al *Proc. Natl. Acad. Sci. U.S.A.* 83, 5639-5643, 1986; Sinha S. K., et al (1993) *J. Immunol.* 150, 5311-5320; WO2004/045520 (Example 4); US2004/005538 (Example 1); WO2003/062401 (claim 9); WO2004/045520 (Example 4); WO91/02536 (FIG. 9.1-9.9); WO2004/020595 (claim 1); Accession: P20023; Q13866; Q14212; EMBL; M26004; AAA35786.1.

(15) CD79b (CD79B, CD79β, IGb (Immunoglobulin-Associated Beta), B29)
Nucleotide
Genbank accession no NM_000626
Genbank version no. NM_000626.2 GI:90193589
Genbank record update date: Jun. 26, 2012 01:53 PM
Polypeptide
Genbank accession no. NP_000617
Genbank version no. NP_000617.1 GI:11038674
Genbank record update date: Jun. 26, 2012 01:53 PM
Cross References
*Proc. Natl. Acad. Sci. U.S.A.* (2003) 100 (7):4126-4131, *Blood* (2002) 100 (9):3068-3076, Muller et al (1992) *Eur. J. Immunol.* 22 (6):1621-1625); WO2004/016225 (claim 2, FIG. 140); WO2003/087768, US2004/101874 (claim 1, page 102); WO2003/062401 (claim 9); WO2002/78524 (Example 2); US2002/150573 (claim 35 5, page 15); U.S. Pat. No. 5,644,033; WO2003/048202 (claim 1, pages 306 and 309); WO 99/58658, U.S. Pat. No. 6,534,482 (claim 13, FIG. 17A/B); WO2000/55351 (claim 11, pages 1145-1146); MIM:147245

(16) FcRH2 (IFGP4, IRTA4, SPAPIA (SH2 Domain Containing Phosphatase Anchor Protein 5 1a), SPAP1B, SPAP1C)
Nucleotide
Genbank accession no NM_030764
Genbank version no. NM_030764.3 GI:227430280
Genbank record update date: Jun. 30, 2012 12:30 AM
Polypeptide
Genbank accession no. NP_110391
Genbank version no. NP_110391.2 GI:19923629
Genbank record update date: Jun. 30, 2012 12:30 AM
Cross References
AY358130); *Genome Res.* 13 (10):2265-2270 (2003), *Immunogenetics* 54 (2):87-95 (2002), *Blood* 99 (8):2662-2669 (2002), *Proc. Natl. Acad. Sci. U.S.A.* 98 (17):9772-9777 (2001), Xu, M. J., et al (2001) *Biochem. Biophys. Res. Commun.* 280 (3):768-775; WO2004/016225 (claim 2); WO2003/077836; WO2001/38490 (claim 5; FIG. 18D-1-18D-2); WO2003/097803 (claim 12);
10 WO2003/089624 (claim 25); MIM:606509.

(17) HER2 (ErbB2)
Nucleotide
Genbank accession no M11730
Genbank version no. M11730.1 GI:183986
Genbank record update date: Jun. 23, 2010 08:47 AM
Polypeptide
Genbank accession no. AAA75493
Genbank version no. AAA75493.1 GI:306840
Genbank record update date: Jun. 23, 2010 08:47 AM
Cross References
Coussens L., et al *Science* (1985) 230(4730):1132-1139); Yamamoto T., et al *Nature* 319, 230-234, 1986; Semba K., et al *Proc. Natl. Acad. Sci. U.S.A.* 82, 6497-6501, 1985; Swiercz J. M., et al *J. Cell Biol.* 165, 869-15 880, 2004; Kuhns J. J., et al *J. Biol. Chem.* 274, 36422-36427, 1999; Cho H.-S., et al *Nature* 421, 756-760, 2003; Ehsani A., et al (1993) *Genomics* 15, 426-429; WO2004/048938 (Example 2); WO2004/027049 (FIG. 11); WO2004/009622; WO2003/081210;
WO2003/089904 (claim 9); WO2003/016475 (claim 1); US2003/118592; WO2003/008537 (claim 1); WO2003/055439 (claim 29; FIG. 1A-B); WO2003/025228 (claim 37; FIG. 5C); 20 WO2002/22636 (Example 13; Page 95-107); WO2002/12341 (claim 68; FIG. 7); WO2002/13847 (Page 71-74); WO2002/14503 (Page 114-117); WO2001/53463 (claim 2; Page 41-46); WO2001/41787 (Page 15); WO2000/44899 (claim 52; FIG. 7); WO2000/20579 (claim 3; FIG. 2); U.S. Pat. No. 5,869,445 (claim 3; Col 31-38); WO9630514 (claim 2; Page 56-61); EP1439393 (claim 7); WO2004/043361 (claim 7); WO2004/022709; WO2001/00244 25 (Example 3; FIG. 4); Accession: PO4626; EMBL; M11767; AAA35808.1. EMBL; M11761; AAA35808.1
Antibodies
Abbott: US20110177095
For example, an antibody comprising CDRs having overall at least 80% sequence identity to CDRs having amino acid sequences of SEQ ID NO:3 (CDR-H1), SEQ ID NO:4 (CDR-H2), SEQ ID NO:5 (CDR-H3), SEQ ID NO:104 and/or SEQ ID NO:6 (CDR-L1), SEQ ID NO:7 (CDR-L2), and SEQ ID NO:8 (CDR-L3), wherein the anti-HER2 antibody or anti-HER2 binding fragment has reduced immunogenicity as compared to an antibody having a VH of SEQ ID NO:1 and a VL of SEQ ID NO:2.

Biogen: US20100119511
For example, ATCC accession numbers: PTA-10355, PTA-10356, PTA-10357, PTA-10358
For example, a purified antibody molecule that binds to HER2 comprising a all six CDR's from an antibody selected from the group consisting of BIIB71F10 (SEQ ID NOs:11, 13), BIIB69A09 (SEQ ID NOs:15, 17); BIIB67F10 (SEQ ID NOs:19, 21); BIIB67F11 (SEQ ID NOs:23, 25), BIIB66A12 (SEQ ID NOs:27, 29), BIIB66C01 (SEQ ID NOs:31, 33), BIIB65C10 (SEQ ID NOs:35, 37), BIIB65H09 (SEQ ID NOs:39, 41) and BIIB65B03 (SEQ ID NOs:43, 45), or CDRs which are identical or which have no more than two alterations from said CDRs. Herceptin (Genentech)—U.S. Pat. No. 6,054,297; ATCC accession no. CRL-10463 (Genentech)

Pertuzumab (Genentech)
US20110117097
   for example, see SEQ IDs No. 15 & 16, SEQ IDs No. 17 & 18, SEQ IDs No. 23 & 24 & ATCC accession numbers HB-12215, HB-12216, CRL 10463, HB-12697.
US20090285837
US20090202546
   for example, ATCC accession numbers: HB-12215, HB-12216, CRL 10463, HB-12698.
US20060088523
   for example, ATCC accession numbers: HB-12215, HB-12216
   for example, an antibody comprising the variable light and variable heavy amino acid sequences in SEQ ID Nos. 3 and 4, respectively.
   for example, an antibody comprising a light chain amino acid sequence selected from SEQ ID No. 15 and 23, and a heavy chain amino acid sequence selected from SEQ ID No. 16 and 24
US20060018899
   for example, ATCC accession numbers: (7C2) HB-12215, (7F3) HB-12216, (4D5) CRL-10463, (2C4) HB-12697.
   for example, an antibody comprising the amino acid sequence in SEQ ID No. 23, or a deamidated and/or oxidized variant thereof.
US2011/0159014
   for example, an antibody having a light chain variable domain comprising the hypervariable regions of SEQ ID NO: 1".
   For example, an antibody having a heavy chain variable domain comprising the hypervariable regions of SEQ ID NO: 2.
US20090187007
Glycotope: TrasGEX antibody http://www.glycotope.com/pipeline
   For example, see International Joint Cancer Institute and Changhai Hospital Cancer Cent: HMTI-Fc Ab—Gao J., et al *BMB Rep.* 2009 Oct. 31; 42(10):636-41.
Symphogen: US20110217305
Union Stem Cell & Gene Engineering, China—Liu H Q., et al *Xi Bao Yu Fen Zi Mian Yi Xue Za Zhi.* 2010 May; 26(5):456-8.

(18) NCA (CEACAM6)
Nucleotide
Genbank accession no M18728
Genbank version no. M18728.1 GI:189084
Genbank record update date: Jun. 23, 2010 08:48 AM
Polypeptide
Genbank accession no. AAA59907
Genbank version no. AAA59907.1 GI:189085
Genbank record update date: Jun. 23, 2010 08:48 AM
Cross References
Barnett T., et al *Genomics* 3, 59-66, 1988; Tawaragi Y., et al *Biochem. Biophys. Res. Commun.* 150, 89-96, 1988; Strausberg R. L., et al *Proc. Natl. Acad. Sci. U.S.A.* 99:16899-16903, 2002; WO2004/063709; EP1439393 (claim 7); WO2004/044178 (Example 4); WO2004/031238; WO2003/042661 (claim 12); WO2002/78524 (Example 2); WO2002/86443 (claim 27; Page 427); WO2002/60317 (claim 2); Accession: P40199; Q14920; EMBL; M29541; AAA59915.1. EMBL; M18728.

(19) MDP (DPEP1)
Nucleotide
Genbank accession no BC017023
Genbank version no. BC017023.1 GI:16877538
Genbank record update date: Mar. 6, 2012 01:00 PM
Polypeptide
Genbank accession no. AAH17023
Genbank version no. AAH17023.1 GI:16877539
Genbank record update date: Mar. 6, 2012 01:00 PM
Cross References
*Proc. Natl. Acad. Sci. U.S.A.* 99 (26):16899-16903 (2002)); WO2003/016475 (claim 1); WO2002/64798 (claim 33; Page 85-87); JP05003790 (FIG. 6-8); WO99/46284 (FIG. 9); MIM:179780.

(20) IL20R-Alpha (IL20Ra, ZCYTOR7)
Nucleotide
Genbank accession no AF184971
Genbank version no. AF184971.1 GI:6013324
Genbank record update date: Mar. 10, 2010 10:00 PM
Polypeptide
Genbank accession no. AAF01320
Genbank version no. AAF01320.1 GI:6013325
Genbank record update date: Mar. 10, 2010 10:00 PM
Cross References
Clark H. F., et al *Genome Res.* 13, 2265-2270, 2003; Mungall A. J., et al *Nature* 425, 805-811, 2003; Blumberg H., et al *Cell* 104, 9-19, 2001; Dumoutier L., et al *J. Immunol.* 167, 3545-3549, 2001; Parrish-Novak J., et al *J. Biol. Chem.* 277, 47517-47523, 2002; Pletnev S., et al (2003) 10 *Biochemistry* 42:12617-12624; Sheikh F., et al (2004) *J. Immunol.* 172, 2006-2010; EP1394274 (Example 11); US2004/005320 (Example 5); WO2003/029262 (Page 74-75); WO2003/002717 (claim 2; Page 63); WO2002/22153 (Page 45-47); US2002/042366 (Page 20-21); WO2001/46261 (Page 57-59); WO2001/46232 (Page 63-65); WO98/37193 (claim 1; Page 55-59); Accession: Q9UHF4; Q6UWA9; Q96SH8; EMBL; AF184971; AAF01320.1.

(21) Brevican (BCAN, BEHAB)
Nucleotide
Genbank accession no AF229053
Genbank version no. AF229053.1 GI:10798902
Genbank record update date: Mar. 11, 2010 12:58 AM
Polypeptide
Genbank accession no. AAG23135
Genbank version no. AAG23135.1 GI:10798903
Genbank record update date: Mar. 11, 2010 12:58 AM Cross References Gary S. C., et al *Gene* 256, 139-147, 2000; Clark H. F., et al *Genome Res.* 13, 2265-2270, 2003; Strausberg R. L., et al *Proc. Natl. Acad. Sci. U.S.A.* 99, 16899-16903, 2002; US2003/186372 (claim 11); US2003/186373 (claim 11); US2003/119131 (claim 1; FIG. 52); US2003/119122 (claim 1; 20 FIG. 52); US2003/119126 (claim 1); US2003/119121 (claim 1; FIG. 52); US2003/119129 (claim 1); US2003/119130 (claim 1); US2003/119128 (claim 1; FIG. 52); US2003/119125 (claim 1); WO2003/016475 (claim 1); WO2002/02634 (claim 1)

(22) EphB2R (DRT, ERK, Hek5, EPHT3, Tyro5)
Nucleotide
Genbank accession no NM_004442
Genbank version no. NM_004442.6 GI:111118979
Genbank record update date: Sep. 8, 2012 04:43 PM
Polypeptide
Genbank accession no. NP_004433
Genbank version no. NP_004433.2 GI:21396504
Genbank record update date: Sep. 8, 2012 04:43 PM
Cross References Chan, J. and Watt, V. M., Oncogene 6 (6), 1057-1061 (1991) Oncogene 10 (5):897-905 (1995), Annu. Rev. Neurosci. 21:309-345 (1998), Int. Rev. Cytol. 196:177-244 (2000)); WO2003042661 (claim 12); WO200053216 (claim 1; Page 41); WO2004065576 (claim 1); WO2004020583 (claim 9); WO2003004529 (Page 128-132); WO200053216 (claim 1; Page 42); MIM:600997.

(23) ASLG659 (B7h)
Nucleotide
Genbank accession no. AX092328
Genbank version no. AX092328.1 GI:13444478
Genbank record update date: Jan. 26, 2011 07:37 AM
Cross References US2004/0101899 (claim 2); WO2003104399 (claim 11); WO2004000221 (FIG. 3); US2003/165504 (claim 1); US2003/124140 (Example 2); US2003/065143 (FIG. 60); WO2002/102235 (claim 13; Page 299); US2003/091580 (Example 2); WO2002/10187 (claim 6; FIG. 10); WO2001/94641 (claim 12; FIG. 7b); WO2002/02624 (claim 13; FIG. 1A-1B); US2002/034749 (claim 54; Page 45-46); WO2002/06317 (Example 2; Page 320-321, claim 34; Page 321-322); WO2002/71928 (Page 468-469); WO2002/02587 (Example 1; FIG. 1); WO2001/40269 (Example 3; Pages 190-192); WO2000/36107 (Example 2; Page 205-207); WO2004/053079 (claim 12); WO2003/004989 (claim 1); WO2002/71928 (Page 233-234, 452-453); WO 01/16318.

(24) PSCA (Prostate Stem Cell Antigen Precursor)
Nucleotide
Genbank accession no AJ297436
Genbank version no. AJ297436.1 GI:9367211
Genbank record update date: Feb. 1, 2011 11:25 AM
Polypeptide
Genbank accession no. CAB97347
Genbank version no. CAB97347.1 GI:9367212
Genbank record update date: Feb. 1, 2011 11:25 AM
Cross References Reiter R. E., et al *Proc. Natl. Acad. Sci. U.S.A.* 95, 1735-1740, 1998; Gu Z., et al *Oncogene* 19, 1288-1296, 2000; *Biochem. Biophys. Res. Commun.* (2000) 275(3):783-788; WO2004/022709; EP1394274 (Example 11); US2004/018553 (claim 17); WO2003/008537 (claim 1); WO2002/81646 (claim 1; Page 164); WO2003/003906 (claim 10; Page 288); WO2001/40309 (Example 1; FIG. 17); US2001/055751 (Example 1; FIG. 1b); WO2000/32752 (claim 18; FIG. 1); WO98/51805 (claim 17; Page 97); WO98/51824 (claim 10; Page 94); WO98/40403 (claim 2; FIG. 1B); Accession: 043653; EMBL; AF043498; AAC39607.1

(25) GEDA
Nucleotide
Genbank accession no AY260763
Genbank version no. AY260763.1 GI:30102448
Genbank record update date: Mar. 11, 2010 02:24 AM
Polypeptide
Genbank accession no. AAP14954
Genbank version no. AAP14954.1 GI:30102449
Genbank record update date: Mar. 11, 2010 02:24 AM
Cross References AP14954 lipoma HMGIC fusion-partnerlike protein/pid=AAP14954.1—*Homo sapiens* (human); WO2003/054152 (claim 20); WO2003/000842 (claim 1); WO2003/023013 (Example 3, claim 20); US2003/194704 (claim 45); GI:30102449;

(26) BAFF-R (B Cell-Activating Factor Receptor, BLyS Receptor 3, BR3)
Nucleotide
Genbank accession no AF116456
Genbank version no. AF116456.1 GI:4585274
Genbank record update date: Mar. 10, 2010 09:44 PM
Polypeptide
Genbank accession no. AAD25356
Genbank version no. AAD25356.1 GI:4585275
Genbank record update date: Mar. 10, 2010 09:44 PM
Cross References BAFF receptor/pid=NP_443177.1—*Homo sapiens*: Thompson, J. S., et al *Science* 293 (5537), 2108-2111 (2001); WO2004/058309; WO2004/011611; WO2003/045422 (Example; Page 32-33); WO2003/014294 (claim 35; FIG. 6B); WO2003/035846 (claim 70; Page 615-616); WO2002/94852 (Col 136-137); WO2002/38766 25 (claim 3; Page 133); WO2002/24909 (Example 3; FIG. 3); MIM: 606269; NP_443177.1; NM_052945_1; AF132600

(27) CD22 (B-Cell Receptor CD22-B Isoform, BL-CAM, Lyb-8, Lyb8, SIGLEC-2, FLJ22814)
Nucleotide
Genbank accession no AK026467
Genbank version no. AK026467.1 GI:10439337
Genbank record update date: Sep. 11, 2006 11:24 PM
Polypeptide
Genbank accession no. BAB15489
Genbank version no. BAB15489.1 GI:10439338
Genbank record update date: Sep. 11, 2006 11:24 PM
Cross References Wilson et al (1991) *J. Exp. Med.* 173:137-146; 30 WO2003/072036 (claim 1; FIG. 1); IM:107266; NP_001762.1; NM_001771_1.

(27a) CD22 (CD22 Molecule)
Nucleotide
Genbank accession no X52785
Genbank version no. X52785.1 GI:29778
Genbank record update date: Feb. 2, 2011 10:09 AM
Polypeptide
Genbank accession no. CAA36988
Genbank version no. CAA36988.1 GI:29779
Genbank record update date: Feb. 2, 2011 10:09 AM
Cross References Stamenkovic I. et al., *Nature* 345 (6270), 74-77 (1990)??
Other Information
Official Symbol: CD22
Other Aliases: SIGLEC-2, SIGLEC2
Other Designations: B-cell receptor CD22; B-lymphocyte cell adhesion molecule; BL-CAM; CD22 antigen; T-cell surface antigen Leu-14; sialic acid binding Ig-like lectin 2; sialic acid-binding Ig-like lectin 2

Antibodies

G5/44 (Inotuzumab): DiJoseph J F., et al *Cancer Immunol Immunother.* 2005 January; 54(1):11-24.

Epratuzumab—Goldenberg D M., et al *Expert Rev Anticancer Ther.* 6(10): 1341-53, 2006.

(28) CD79a (CD79A, CD79Alpha), Immunoglobulin-Associated Alpha, a B Cell-Specific Protein That Covalently Interacts With Ig Beta (CD79B) and Forms a Complex on the Surface With Ig M 35 molecules, transduces a signal involved in B-cell differentiation), pI: 4.84, MW: 25028 TM: 2 [P] Gene Chromosome: 19q13.2).

Nucleotide
Genbank accession no NM_001783
Genbank version no. NM_001783.3 GI:90193587
Genbank record update date: Jun. 26, 2012 01:48 PM
Polypeptide
Genbank accession no. NP_001774
Genbank version no. NP_001774.1 GI:4502685
Genbank record update date: Jun. 26, 2012 01:48 PM
Cross References
WO2003/088808, US2003/0228319; WO2003/062401 (claim 9); US2002/150573 (claim 4, pages 13-14); WO99/58658 (claim 13, FIG. 16); WO92/07574 (FIG. 1); U.S. Pat. No. 5,644,033; Ha et al (1992) *J. Immunol.* 148(5):1526-1531; Müller et al (1992) *Eur. J. Immunol.* 22:1621-1625; Hashimoto et al (1994) Immunogenetics 40(4):287-295; Preud'homme et al (1992) *Clin. Exp. 5 Immunol.* 90(1):141-146; Yu et al (1992) *J. Immunol.* 148(2) 633-637; Sakaguchi et al (1988) *EMBO J.* 7(11):3457-3464

(29) CXCR5 (Burkitt's Lymphoma Receptor 1, a G Protein-Coupled Receptor That is Activated by the CXCL13 Chemokine, Functions in Lymphocyte Migration and Humoral Defense, Plays a 10 Role in HIV-2 Infection and Perhaps Development of AIDS, Lymphoma, Myeloma, and Leukemia); 372 aa, pI: 8.54 MW: 41959 TM: 7 [P] Gene Chromosome: 11q23.3, Nucleotide
Genbank accession no NM_001716
Genbank version no. NM_001716.4 GI:342307092
Genbank record update date: Sep. 30, 2012 01:49 PM
Polypeptide
Genbank accession no. NP_001707
Genbank version no. NP_001707.1 GI:4502415
Genbank record update date: Sep. 30, 2012 01:49 PM
Cross References
WO2004/040000; WO2004/015426; US2003/105292 (Example 2); U.S. Pat. No. 6,555,339 (Example 2); WO2002/61087 (FIG. 1); WO2001/57188 (claim 20, page 269); WO2001/72830 (pages 12-13); WO2000/22129 (Example 1, pages 152-153, 15 Example 2, pages 254-256); WO99/28468 (claim 1, page 38); U.S. Pat. No. 5,440,021 (Example 2, col 49-52); WO94/28931 (pages 56-58); WO92/17497 (claim 7, FIG. 5); Dobner et al (1992) *Eur. J. Immunol.* 22:2795-2799; Barella et al (1995) *Biochem. J.* 309:773-779

(30) HLA-DOB (Beta Subunit of MHC Class II Molecule (Ia Antigen) That binds Peptides and 20 Presents Them to CD4+ T Lymphocytes); 273 aa, pI: 6.56, MW: 30820.TM: 1 [P] Gene Chromosome: 6p21.3)

Nucleotide
Genbank accession no NM_002120
Genbank version no. NM_002120.3 GI:118402587
Genbank record update date: Sep. 8, 2012 04:46 PM
Polypeptide
Genbank accession no. NP_002111
Genbank version no. NP_002111.1 GI:4504403
Genbank record update date: Sep. 8, 2012 04:46 PM
Cross References
Tonnelle et al (1985) *EMBO J.* 4(11):2839-2847; Jonsson et al (1989) *Immunogenetics* 29(6): 411-413; Beck et al (1992) *J. Mol. Biol.* 228:433-441; Strausberg et al (2002) *Proc. Natl. Acad. Sci USA* 99:16899-16903; Servenius et al (1987) *J. Biol. Chem.* 262:8759-8766; Beck et al (1996) *J. Mol. Biol.* 25 255:1-13; Naruse et al (2002) *Tissue Antigens* 59:512-519; WO99/58658 (claim 13, FIG. 15); U.S. Pat. No. 6,153,408 (Col 35-38); U.S. Pat. No. 5,976,551 (col 168-170); U.S. Pat. No. 6,011,146 (col 145-146); Kasahara et al (1989) *Immunogenetics* 30(1):66-68; Larhammar et al (1985) *J. Biol. Chem.* 260(26):14111-14119

(31) P2X5 (Purinergic Receptor P2X Ligand-Gated Ion Channel 5, an Ion Channel Gated by Extracellular ATP, May be Involved in Synaptic Transmission and Neurogenesis, Deficiency May Contribute to the Pathophysiology of Idiopathic Detrusor Instability); 422 aa, pI: 7.63, MW: 47206 TM: 1 [P] Gene Chromosome: 17p13.3).

Nucleotide
Genbank accession no NM_002561
Genbank version no. NM_002561.3 GI:325197202
Genbank record update date: Jun. 27, 2012 12:41 AM
Polypeptide
Genbank accession no. NP_002552
Genbank version no. NP_002552.2 GI:28416933
Genbank record update date: Jun. 27, 2012 12:41 AM
Cross References
Le et al (1997) *FEBS Lett.* 418(1-2):195-199; WO2004/047749; WO2003/072035 (claim 10); Touchman et al (2000) *Genome Res.* 10:165-173; WO2002/22660 (claim 20); WO2003/093444 (claim 1); WO2003/087768 (claim 1); WO2003/029277 (page 82)

(32) CD72 (B-Cell Differentiation Antigen CD72, Lyb-2); 359 aa, pI: 8.66, MW: 40225, TM: 1 5 [P] Gene Chromosome: 9p13.3).

Nucleotide
Genbank accession no NM_001782
Genbank version no. NM_001782.2 GI:194018444
Genbank record update date: Jun. 26, 2012 01:43 PM
Polypeptide
Genbank accession no. NP_001773
Genbank version no. NP_001773.1 GI:4502683
Genbank record update date: Jun. 26, 2012 01:43 PM
Cross References
WO2004042346 (claim 65); WO2003/026493 (pages 51-52, 57-58); WO2000/75655 (pages 105-106); Von Hoegen et al (1990) *J. Immunol.* 144(12):4870-4877; Strausberg et al (2002) *Proc. Natl. Acad. Sci USA* 99:16899-16903.

(33) LY64 (Lymphocyte Antigen 64 (RP105), Type I Membrane Protein of the Leucine Rich Repeat (LRR) Family, Regulates B-Cell Activation and Apoptosis, Loss of Function is Associated With Increased Disease Activity in Patients With Systemic Lupus Erythematosis); 661 aa, pI: 6.20, MW: 74147 TM: 1 [P] Gene Chromosome: 5q12).

Nucleotide
Genbank accession no NM_005582
Genbank version no. NM_005582.2 GI:167555126
Genbank record update date: Sep. 2, 2012 01:50 PM
Polypeptide
Genbank accession no. NP_005573
Genbank version no. NP_005573.2 GI:167555127
Genbank record update date: Sep. 2, 2012 01:50 PM Cross References US2002/193567; WO97/07198 (claim 11, pages 39-42); Miura et al (1996) 15 *Genomics* 38(3):299-304; Miura et al (1998) *Blood* 92:2815-2822; WO2003/083047; WO97/44452 (claim 8, pages 57-61); WO2000/12130 (pages 24-26).

(34) FcRH1 (Fc Receptor-Like Protein 1, a Putative Receptor for the Immunoglobulin Fc Domain That Contains C2 Type Ig-Like and ITAM Domains, May Have a Role in B-Lymphocyte 20 Differentiation); 429 aa, pI: 5.28, MW: 46925 TM: 1 [P] Gene Chromosome: 1q21-1q22)

Nucleotide
Genbank accession no NM_052938
Genbank version no. NM_052938.4 GI:226958543
Genbank record update date: Sep. 2, 2012 01:43 PM
Polypeptide
Genbank accession no. NP_443170
Genbank version no. NP_443170.1 GI:16418419
Genbank record update date: Sep. 2, 2012 01:43 PM
Cross References
WO2003/077836; WO2001/38490 (claim 6, FIG. 18E-1-18-E-2); Davis et al (2001) *Proc. Natl. Acad. Sci USA* 98(17):9772-9777; WO2003/089624 (claim 8); EP1347046 (claim 1); WO2003/089624 (claim 7).

(35) IRTA2 (Immunoglobulin Superfamily Receptor Translocation Associated 2, a Putative Immunoreceptor With Possible Roles in B Cell Development and Lymphoma Genesis; Deregulation of the Gene by Translocation Occurs in Some B Cell Malignancies); 977 aa, pI: 6.88, MW: 106468, TM: 1 [P] Gene Chromosome: 1q21)

Nucleotide
Genbank accession no AF343662
Genbank version no. AF343662.1 GI:13591709
Genbank record update date: Mar. 11, 2010 01:16 AM
Polypeptide
Genbank accession no. AAK31325
Genbank version no. AAK31325.1 GI:13591710
Genbank record update date: Mar. 11, 2010 01:16 AM
Cross References
AF343663, AF343664, AF343665, AF369794, AF397453, AK090423, AK090475, AL834187, AY358085; Mouse:AK089756, AY158090, AY506558; NP_112571.1; WO2003/024392 (claim 2, FIG. 97); Nakayama et al (2000) *Biochem. Biophys. Res. Commun.* 277(1):124-127; WO2003/077836; WO2001/38490 (claim 3, FIG. 18B-1-18B-2).

(36) TENB2 (TMEFF2, Tomoregulin, TPEF, HPP1, TR, Putative Transmembrane 35 Proteoglycan, Related to the EGF/Heregulin Family of Growth Factors and Follistatin); 374 aa)

Nucleotide
Genbank accession no AF179274
Genbank version no. AF179274.2 GI:12280939
Genbank record update date: Mar. 11, 2010 01:05 AM
Polypeptide
Genbank accession no. AAD55776
Genbank version no. AAD55776.2 GI:12280940
Genbank record update date: Mar. 11, 2010 01:05 AM
Cross References
NCBI Accession: AAD55776, AAF91397, AAG49451, NCBI RefSeq: NP_057276; NCBI Gene: 23671; OMIM: 605734; SwissProt Q9UIK5; AY358907, CAF85723, CQ782436; WO2004/074320; JP2004113151; WO2003/042661; WO2003/009814; EP1295944 (pages 69-70); WO2002/30268 (page 329); WO2001/90304; US2004/249130; US2004/022727; WO2004/063355; US2004/197325; US2003/232350; 5 US2004/005563; US2003/124579; Horie et al (2000) *Genomics* 67:146-152; Uchida et al (1999) *Biochem. Biophys. Res. Commun.* 266:593-602; Liang et al (2000) *Cancer Res.* 60:4907-12; Glynne-Jones et al (2001) *Int J Cancer.* October 15; 94(2):178-84.

(37) PSMA-FOLH1 (Folate Hydrolase (Prostate-Specific Membrane Antigen) 1)

Nucleotide
Genbank accession no M99487
Genbank version no. M99487.1 GI:190663
Genbank record update date: Jun. 23, 2010 08:48 AM
Polypeptide
Genbank accession no. AAA60209
Genbank version no. AAA60209.1 GI:190664
Genbank record update date: Jun. 23, 2010 08:48 AM
Cross References
Israeli R. S., et al *Cancer Res.* 53 (2), 227-230 (1993)
Other Information
Official Symbol: FOLH1
Other Aliases: GIG27, FGCP, FOLH, GCP2, GCPII, NAALAD1, NAALAdase, PSM, PSMA, mGCP
Other Designations: N-acetylated alpha-linked acidic dipeptidase 1; N-acetylated-alpha-linked acidic dipeptidase I; NAALADase I; cell growth-inhibiting gene 27 protein; folylpoly-gamma-glutamate carboxypeptidase; glutamate carboxylase II; glutamate carboxypeptidase 2; glutamate carboxypeptidase II; membrane glutamate carboxypeptidase; prostate specific membrane antigen variant F; pteroyl-poly-gamma-glutamate carboxypeptidase Antibodies U.S. Pat. No. 7,666,425:

Antibodies produces by Hybridomas having the following ATCC references: ATCC accession No. HB-12101, ATCC accession No. HB-12109, ATCC accession No. HB-12127 and ATCC accession No. HB-12126.

Proscan: a monoclonal antibody selected from the group consisting of 8H12, 3E11, 17G1, 29B4, 30C1 and 20F2 (U.S. Pat. No. 7,811,564; Moffett S., et al Hybridoma (Larchmt). 2007 December; 26(6):363-72).

Cytogen: monoclonal antibodies 7E11-05 (ATCC accession No. HB 10494) and 9H10-A4 (ATCC accession No. HB11430)—U.S. Pat. No. 5,763,202

GlycoMimetics: NUH2—ATCC accession No. HB 9762 (U.S. Pat. No. 7,135,301)

Human Genome Science: HPRAJ70—ATCC accession No. 97131 (U.S. Pat. No. 6,824,993); Amino acid sequence encoded by the cDNA clone (HPRAJ70) deposited as American Type Culture Collection ("ATCC") Deposit No. 97131

Medarex: Anti-PSMA antibodies that lack fucosyl residues—U.S. Pat. No. 7,875,278

Mouse anti-PSMA antibodies include the 3F5.4G6, 3D7.1.1, 4E10-1.14, 3E11, 4D8, 3E6, 3C9, 2C7, 1G3, 3C4, 3C6, 4D4, 1G9, 5C8B9, 3G6, 4C8B9, and monoclonal antibodies. Hybridomas secreting 3F5.4G6, 3D7.1.1, 4E10-1.14, 3E11, 4D8, 3E6, 3C9, 2C7, 1G3, 3C4, 3C6, 4D4, 1 G9, 5C8B9, 3G6 or 4C8B9 have been publicly deposited and are described in U.S. Pat. No. 6,159,508. Relevant hybridomas have been publicly deposited and are described in U.S. Pat. No. 6,107,090. Moreover, humanized anti-PSMA antibodies, including a humanized version of J591, are described in further detail in PCT Publication WO 02/098897.

Other mouse anti-human PSMA antibodies have been described in the art, such as mAb 107-1A4 (Wang, S. et al. (2001) Int. J. Cancer 92:871-876) and mAb 2C9 (Kato, K. et al. (2003) Int. J. Urol. 10:439-444).

Examples of human anti-PSMA monoclonal antibodies include the 4A3, 7F12, 8C12, 8A11, 16F9, 2A10, 2C6, 2F5 and 1C3 antibodies, isolated and structurally characterized as originally described in PCT Publications WO 01/09192 and WO 03/064606 and in U.S. Provisional Application Ser. No. 60/654,125, entitled "Human Monoclonal Antibodies to Prostate Specific Membrane Antigen (PSMA)", filed on Feb. 18, 2005. The V.sub.H amino acid sequences of 4A3, 7F12, 8C12, 8A11, 16F9, 2A10, 2C6, 2F5 and 1C3 are shown in SEQ ID NOs: 1-9, respectively. The V.sub.L amino acid sequences of 4A3, 7F12, 8C12, 8A11, 16F9, 2A10, 2C6, 2F5 and 1C3 are shown in SEQ ID NOs: 10-18, respectively.

Other human anti-PSMA antibodies include the antibodies disclosed in PCT Publication WO 03/034903 and US Application No. 2004/0033229.

NW Biotherapeutics: A hybridoma cell line selected from the group consisting of 3F5.4G6 having ATCC accession number HB12060, 3D7-1.I. having ATCC accession number HB12309, 4E10-1.14 having ATCC accession number HB12310, 3E11 (ATCC HB12488), 4D8 (ATCC HB12487), 3E6 (ATCC HB12486), 3C9 (ATCC HB12484), 2C7 (ATCC HB12490), 1G3 (ATCC HB12489), 3C4 (ATCC HB12494), 3C6 (ATCC HB12491), 4D4 (ATCC HB12493), 1G9 (ATCC HB12495), 5C8B9 (ATCC HB12492) and 3G6 (ATCC HB12485)—see U.S. Pat. No. 6,150,508

PSMA Development Company/Progenics/Cytogen—Seattle Genetics: mAb 3.9, produced by the hybridoma deposited under ATCC Accession No. PTA-3258 or mAb 10.3, produced by the hybridoma deposited under ATCC Accession No. PTA-3347—U.S. Pat. No. 7,850,971

PSMA Development Company—Compositions of PSMA antibodies (US 20080286284, Table 1)
  This application is a divisional of U.S. patent application Ser. No. 10/395,894, filed on Mar. 21, 2003 (U.S. Pat. No. 7,850,971)
  University Hospital Freiburg, Germany—mAbs 3/A12, 3/E7, and 3/F11 (Wolf P., et al Prostate. 2010 Apr. 1; 70(5):562-9).
  (38) SST (Somatostatin Receptor; Note That There are 5 Subtypes)
    (38.1) SSTR2 (Somatostatin Receptor 2)
    Nucleotide
    Genbank accession no NM_001050
    Genbank version no. NM_001050.2 GI:44890054
    Genbank record update date: Aug. 19, 2012 01:37 PM
    Polypeptide
    Genbank accession no. NP_001041
    Genbank version no. NP_001041.1 GI:4557859
    Genbank record update date: Aug. 19, 2012 01:37 PM
    Cross References
    Yamada Y., et al Proc. Natl. Acad. Sci. U.S.A. 89 (1), 251-255 (1992); Susini C., et al Ann Oncol. 2006 December; 17(12):1733-42
    Other Information
    Official Symbol: SSTR2
    Other Designations: SRIF-1; SS2R; somatostatin receptor type 2
    (38.2) SSTR5 (Somatostatin Receptor 5)
    Nucleotide
    Genbank accession no D16827
    Genbank version no. D16827.1 GI:487683
    Genbank record update date: Aug. 1, 2006 12:45 PM
    Polypeptide
    Genbank accession no. BAA04107
    Genbank version no. BAA04107.1 GI:487684
    Genbank record update date: Aug. 1, 2006 12:45 PM
    Cross References
    Yamada, Y., et al Biochem. Biophys. Res. Commun. 195 (2), 844-852 (1993)

Other Information
    Official Symbol: SSTR5
    Other Aliases: SS-5-R
    Other Designations: Somatostatin receptor subtype 5; somatostatin receptor type 5
    (38.3) SSTR1
    (38.4) SSTR3
    (38.5) SSTR4
  AvB6—Both Subunits (39+40)
    (39) ITGAV (Integrin, alpha V;
    Nucleotide
    Genbank accession no M14648 J02826 M18365
    Genbank version no. M14648.1 GI:340306
    Genbank record update date: Jun. 23, 2010 08:56 AM
    Polypeptide
    Genbank accession no. AAA36808
    Genbank version no. AAA36808.1 GI:340307
    Genbank record update date: Jun. 23, 2010 08:56 AM
    Cross References
    Suzuki S., et al Proc. Natl. Acad. Sci. U.S.A. 83 (22), 8614-8618 (1986)
    Other Information
    Official Symbol: ITGAV
    Other Aliases: CD51, MSK8, VNRA, VTNR
    Other Designations: antigen identified by monoclonal antibody L230; integrin alpha-V; integrin alphaVbeta3; integrin, alpha V (vitronectin receptor, alpha polypeptide, antigen CD51); vitronectin receptor subunit alpha
    (40) ITGB6 (Integrin, Beta 6)
    Nucleotide
    Genbank accession no NM_000888
    Genbank version no. NM_000888.3 GI:9966771
    Genbank record update date: Jun. 27, 2012 12:46 AM
    Polypeptide
    Genbank accession no. NP_000879
    Genbank version no. NP_000879.2 GI:9625002
    Genbank record update date: Jun. 27, 2012 12:46 AM
    Cross References
    Sheppard D. J., et al Biol. Chem. 265 (20), 11502-11507 (1990)
    Other Information
    Official Symbol: ITGB6
    Other Designations: integrin beta-6
    Antibodies
    Biogen: U.S. Pat. No. 7,943,742—Hybridoma clones 6.3G9 and 6.8G6 were deposited with the ATCC, accession numbers ATCC PTA-3649 and -3645, respectively.
    Biogen: U.S. Pat. No. 7,465,449—In some embodiments, the antibody comprises the same heavy and light chain polypeptide sequences as an antibody produced by hybridoma 6.1A8, 6.3G9, 6.8G6, 6.2B1, 6.2B10, 6.2A1, 6.2E5, 7.1G10, 7.7G5, or 7.1C5.
    Centocor (J&J): U.S. Pat. No. 7,550,142; U.S. Pat. No. 7,163,681
      For example in U.S. Pat. No. 7,550,142—an antibody having human heavy chain and human light chain variable regions comprising the amino acid sequences shown in SEQ ID NO: 7 and SEQ ID NO: 8.
    Seattle Genetics: 15H3 (Ryan M C., et al Cancer Res Apr. 15, 2012; 72(8 Supplement): 4630)
  (41) CEACAM5 (Carcinoembryonic Antigen-Related Cell Adhesion Molecule 5)
    Nucleotide
    Genbank accession no M17303
    Genbank version no. M17303.1 GI:178676
    Genbank record update date: Jun. 23, 2010 08:47 AM Polypeptide
Genbank accession no. AAB59513
Genbank version no. AAB59513.1 GI:178677
Genbank record update date: Jun. 23, 2010 08:47 AM
Cross References
Beauchemin N., et al *Mol. Cell. Biol.* 7 (9), 3221-3230 (1987)
Other Information
Official Symbol: CEACAM5
Other Aliases: CD66e, CEA
Other Designations: meconium antigen 100
Antibodies
AstraZeneca-MedImmune:US 20100330103; US20080057063;
US20020142359
for example an antibody having complementarity determining regions (CDRs) with the following sequences: heavy chain; CDR1-DNYMH, CDR2-WIDPENGDTE YAPKFRG, CDR3-LIYAGY-LAMD Y; and light chain CDR1-SASSSVTYMH, CDR2-STSNLAS, CDR3-QQRSTYPLT.
Hybridoma 806.077 deposited as European Collection of Cell Cultures (ECACC) deposit no. 96022936.
Research Corporation Technologies, Inc.: U.S. Pat. No. 5,047,507
Bayer Corporation: U.S. Pat. No. 6,013,772
BioAlliance: U.S. Pat. No. 7,982,017; U.S. Pat. No. 7,674,605
U.S. Pat. No. 7,674,605
an antibody comprising the heavy chain variable region sequence from the amino acid sequence of SEQ ID NO: 1, and the light chain variable region sequence from the amino acid sequence of SEQ ID NO:2.
an antibody comprising the heavy chain variable region sequence from the amino acid sequence of SEQ ID NO:5, and the light chain variable region sequence from the amino acid sequence of SEQ ID NO:6.
Celltech Therapeutics Limited: U.S. Pat. No. 5,877,293
The Dow Chemical Company: U.S. Pat. No. 5,472,693; U.S. Pat. No. 6,417,337; U.S. Pat. No. 6,333,405
U.S. Pat. No. 5,472,693—for example, ATCC No. CRL-11215
U.S. Pat. No. 6,417,337—for example, ATCC CRL-12208
U.S. Pat. No. 6,333,405—for example, ATCC CRL-12208
Immunomedics, Inc: U.S. Pat. No. 7,534,431; U.S. Pat. No. 7,230,084; U.S. Pat. No. 7,300,644; U.S. Pat. No. 6,730,300;
US20110189085
an antibody having CDRs of the light chain variable region comprise: CDR1 comprises KASQD-VGTSVA (SEQ ID NO: 20); CDR2 comprises WTSTRHT (SEQ ID NO: 21); and CDR3 comprises QQYSLYRS (SEQ ID NO: 22);
and the CDRs of the heavy chain variable region of said anti-CEA antibody comprise: CDR1 comprises TYWMS (SEQ ID NO: 23); CDR2 comprises EIH-PDSSTINYAPSLKD (SEQ ID NO: 24); and CDR3 comprises LYFGFPWFAY (SEQ ID NO: 25).
US20100221175; US20090092598; US20070202044; US20110064653; US20090185974; US20080069775.
(42) MET (Met Proto-Oncogene; Hepatocyte Growth Factor Receptor) Nucleotide
Genbank accession no M35073
Genbank version no. M35073.1 GI:187553
Genbank record update date: Mar. 6, 2012 11:12 AM
Polypeptide
Genbank accession no. AAA59589
Genbank version no. AAA59589.1 GI:553531
Genbank record update date: Mar. 6, 2012 11:12 AM
Cross References
Dean M., et al *Nature* 318 (6044), 385-388 (1985)
Other Information
Official Symbol: MET
Other Aliases: AUTS9, HGFR, RCCP2, c-Met
Other Designations: HGF receptor; HGF/SF receptor; SF receptor; hepatocyte growth factor receptor; met proto-oncogene tyrosine kinase; proto-oncogene c-Met; scatter factor receptor; tyrosine-protein kinase Met
Antibodies
Abgenix/Pfizer: US20100040629
for example, the antibody produced by hybridoma 13.3.2 having American Type Culture Collection (ATCC) accession number PTA-5026; the antibody produced by hybridoma 9.1.2 having ATCC accession number PTA-5027; the antibody produced by hybridoma 8.70.2 having ATCC accession number PTA-5028; or the antibody produced by hybridoma 6.90.3 having ATCC accession number PTA-5029.
Amgen/Pfizer: US20050054019
for example, an antibody comprising a heavy chain having the amino acid sequences set forth in SEQ ID NO: 2 where X2 is glutamate and X4 is serine and a light chain having the amino acid sequence set forth in SEQ ID NO: 4 where X8 is alanine, without the signal sequences; an antibody comprising a heavy chain having the amino acid sequences set forth in SEQ ID NO: 6 and a light chain having the amino acid sequence set forth in SEQ ID NO: 8, without the signal sequences; an antibody comprising a heavy chain having the amino acid sequences set forth in SEQ ID NO: 10 and a light chain having the amino acid sequence set forth in SEQ ID NO: 12, without the signal sequences; or an antibody comprising a heavy chain having the amino acid sequences set forth in SEQ ID NO: 14 and a light chain having the amino acid sequence set forth in SEQ ID NO: 16, without the signal sequences.
Agouron Pharmaceuticals (Now Pfizer): US20060035907
Eli Lilly: US20100129369
Genentech: U.S. Pat. No. 5,686,292; US20100028337; US20100016241; US20070129301; US20070098707; US20070092520, US20060270594; US20060134104; US20060035278; US20050233960; US20050037431
U.S. Pat. No. 5,686,292—for example, ATCC HB-11894 and ATCC HB-11895
US 20100016241—for example, ATCC HB-11894 (hybridoma 1A3.3.13) or HB-11895 (hybridoma 5D5.11.6)
National Defense Medical Center, Taiwan: Lu R M., et al Biomaterials. 2011 April; 32(12):3265-74.
Novartis: US20090175860
for example, an antibody comprising the sequences of CDR1, CDR2 and CDR3 of heavy chain 4687, wherein the sequences of CDR1, CDR2, and CDR3 of heavy chain 4687 are residues 26-35, 50-65, and 98-102, respectively, of SEQ ID NO: 58; and the sequences of CDR1, CDR2, and CDR3 of light chain 5097, wherein the sequences of CDR1, CDR2, and CDR3 of light chain 5097 are residues 24-39, 55-61, and 94-100 of SEQ ID NO: 37.
Pharmacia Corporation: US20040166544
Pierre Fabre: US20110239316, US20110097262, US20100115639

Sumsung: US 20110129481—for example a monoclonal antibody produced from a hybridoma cell having accession number KCLRF-BP-00219 or accession number of KCLRF-BP-00223.

Samsung: US 20110104176—for example an antibody produced by a hybridoma cell having Accession Number: KCLRF-BP-00220.

University of Turin Medical School: DN-30 Pacchiana G., et al *J Biol Chem.* 2010 Nov. 12; 285(46):36149-57

Van Andel Research Institute: Jiao Y., et al *Mol Biotechnol.* 2005 Septwmber; 31(1):41-54.

(43) MUC1 (Mucin 1, Cell Surface Associated)
Nucleotide
Genbank accession no J05581
Genbank version no. J05581.1 GI:188869
Genbank record update date: Jun. 23, 2010 08:48 AM
Polypeptide
Genbank accession no. AAA59876
Genbank version no. AAA59876.1 GI:188870
Genbank record update date: Jun. 23, 2010 08:48 AM
Cross References
Gendler S. J., et al *J. Biol. Chem.* 265 (25), 15286-15293 (1990)
Other Information
Official Symbol: MUC1
Other Aliases: RP11-263K19.2, CD227, EMA, H23AG, KL-6, MAM6, MUC-1, MUC-1/SEC, MUC-1/X, MUC1/ZD, PEM, PEMT, PUM
Other Designations: DF3 antigen; H23 antigen; breast carcinoma-associated antigen DF3; carcinoma-associated mucin; episialin; krebs von den Lungen-6; mucin 1, transmembrane; mucin-1; peanut-reactive urinary mucin; polymorphic epithelial mucin; tumor associated epithelial mucin; tumor-associated epithelial membrane antigen; tumor-associated mucin
Antibodies
AltaRex-Quest Pharma Tech: U.S. Pat. No. 6,716,966—for example an Alt-1 antibody produced by the hybridoma ATCC No PTA-975.
AltaRex-Quest Pharma Tech: U.S. Pat. No. 7,147,850
CRT: 5E5—Sørensen A L., et al *Glycobiology* vol. 16 no. 2 pp. 96-107, 2006; HMFG2—Burchell J., et al *Cancer Res.,* 47, 5476-5482 (1987)
Glycotope GT-MAB: GT-MAB 2.5-GEX (Website: http://www.glycotope.com/pipeline/pankomab-gex)
Immunogen: U.S. Pat. No. 7,202,346
for example, antibody MJ-170: hybridoma cell line MJ-170 ATCC accession no. PTA-5286Monoclonal antibody MJ-171: hybridoma cell line MJ-171 ATCC accession no. PTA-5287; monoclonal antibody MJ-172: hybridoma cell line MJ-172 ATCC accession no. PTA-5288; or monoclonal antibody MJ-173: hybridoma cell line MJ-173 ATCC accession no. PTA-5302
Immunomedics: U.S. Pat. No. 6,653,104
Ramot Tel Aviv Uni: U.S. Pat. No. 7,897,351
Regents Uni. CA: U.S. Pat. No. 7,183,388; US20040005647; US20030077676.
Roche GlycArt: U.S. Pat. No. 8,021,856
Russian National Cancer Research Center: Imuteran-Ivanov P K., et al *Biotechnol J.* 2007 July; 2(7):863-70
Technische Univ Braunschweig: (IIB6, HT186-B7, HT186-D11, HT186-G2, HT200-3A-C1, HT220-M-D1, HT220-M-G8)—Thie H., et al *PLoS One.* 2011 Jan. 14; 6(1):e15921

(44) CA9 (Carbonic Anhydrase IX)
Nucleotide
Genbank accession no. X66839
Genbank version no. X66839.1 GI:1000701
Genbank record update date: Feb. 2, 2011 10:15 AM
Polypeptide
Genbank accession no. CAA47315
Genbank version no. CAA47315.1 GI:1000702
Genbank record update date: Feb. 2, 2011 10:15 AM
Cross References
Pastorek J., et al *Oncogene* 9 (10), 2877-2888 (1994)
Other Information
Official Symbol: CA9
Other Aliases: CAIX, MN
Other Designations: CA-IX; P54/58N; RCC-associated antigen G250; RCC-associated protein G250; carbonate dehydratase IX; carbonic anhydrase 9; carbonic dehydratase; membrane antigen MN; pMW1; renal cell carcinoma-associated antigen G250
Antibodies
Abgenix/Amgen: US20040018198
Affibody: Anti-CAIX Affibody molecules (http://www.affibody.com/en/Product-Portfolio/Pipeline/)
Bayer: U.S. Pat. No. 7,462,696
Bayer/Morphosys: 3ee9 mAb—Petrul H M., et al *Mol Cancer Ther.* 2012 February; 11(2):340-9
Harvard Medical School: Antibodies G10, G36, G37, G39, G45, G57, G106, G119, G6, G27, G40 and G125. Xu C., et al *PLoS One.* 2010 Mar. 10; 5(3):e9625
Institute of Virology, Slovak Academy of Sciences (Bayer)—U.S. Pat. No. 5,955,075
for example, M75—ATCC Accession No. HB 11128 or MN12—ATCC Accession No. HB 11647
Institute of Virology, Slovak Academy of Sciences: U.S. Pat. No. 7,816,493
for example the M75 monoclonal antibody that is secreted from the hybridoma VU-M75, which was deposited at the American Type Culture Collection under ATCC No. HB 11128; or the V/10 monoclonal antibody secreted from the hybridoma V/10-VU, which was deposited at the International Depository Authority of the Belgian Coordinated Collection of Microorganisms (BCCM) at the Laboratorium voor Moleculaire Biologie-Plasmidencollectie (LMBP) at the Universeit Gent in Gent, Belgium, under Accession No. LMBP 6009CB.
Institute of Virology, Slovak Academy of Sciences US20080177046; US20080176310; US20080176258; US20050031623
Novartis: US20090252738
Wilex: U.S. Pat. No. 7,691,375—for example the antibody produced by the hybridoma cell line DSM ASC 2526.
Wilex: US20110123537; Rencarex: Kennett R H., et al *Curr Opin Mol Ther.* 2003 February; 5(1):70-5
Xencor: US20090162382

(45) EGFRvIII (Epidermal Growth Factor Receptor (EGFR), Transcript Variant 3,
Nucleotide
Genbank accession no. NM_201283
Genbank version no. NM_201283.1 GI:41327733
Genbank record update date: Sep. 30, 2012 01:47 PM
Polypeptide
Genbank accession no. NP_958440
Genbank version no. NP_958440.1 GI:41327734
Genbank record update date: Sep. 30, 2012 01:47 PM
Cross-References
Batra S K., et al *Cell Growth Differ* 1995; 6:1251-1259.
Antibodies:
U.S. Pat. No. 7,628,986 and U.S. Pat. No. 7,736,644 (Amgen)

For example, a heavy chain variable region amino acid sequence selected from the group consisting of SEQ ID NO: 142 and variants & a light chain variable region amino acid sequence selected from the group consisting of: SEQ ID NO: 144 and variants.

US20100111979 (Amgen)

For example, an antibody comprising a heavy chain amino acid sequence comprising:

CDR1 consisting of a sequence selected from the group consisting of the amino acid sequences for the CDR1 region of antibodies 13.1.2 (SEQ ID NO: 138), 131 (SEQ ID NO: 2), 170 (SEQ ID NO: 4), 150 (SEQ ID NO: 5), 095 (SEQ ID NO: 7), 250 (SEQ ID NO: 9), 139 (SEQ ID NO: 10), 211 (SEQ ID NO: 12), 124 (SEQ ID NO: 13), 318 (SEQ ID NO: 15), 342 (SEQ ID NO: 16), and 333 (SEQ ID NO: 17);

CDR2 consisting of a sequence selected from the group consisting of the amino acid sequences for the CDR2 region of antibodies 13.1.2 (SEQ ID NO: 138), 131 (SEQ ID NO: 2), 170 (SEQ ID NO: 4), 150 (SEQ ID NO: 5), 095 (SEQ ID NO: 7), 250 (SEQ ID NO: 9), 139 (SEQ ID NO: 10), 211 (SEQ ID NO: 12), 124 (SEQ ID NO: 13), 318 (SEQ ID NO: 15), 342 (SEQ ID NO: 16), and 333 (SEQ ID NO: 17); and CDR3 consisting of a sequence selected from the group consisting of the amino acid sequences for the CDR3 region of antibodies 13.1.2 (SEQ ID NO: 138), 131 (SEQ ID NO: 2), 170 (SEQ ID NO: 4), 150 (SEQ ID NO: 5), 095 (SEQ ID NO: 7), 250 (SEQ ID NO: 9), 139 (SEQ ID NO: 10), 211 (SEQ ID NO: 12), 124 (SEQ ID NO: 13), 318 (SEQ ID NO: 15), 342 (SEQ ID NO: 16), and 333 (SEQ ID NO: 17).

US20090240038 (Amgen)

For example, an antibody having at least one of the heavy or light chain polypeptides comprises an amino acid sequence that is at least 90% identical to the amino acid sequence selected from the group consisting of: SEQ ID NO: 2, SEQ ID NO: 19, SEQ ID NO: 142, SEQ ID NO: 144, and any combination thereof.

US20090175887 (Amgen)

For example, an antibody having a heavy chain amino acid sequence selected from the group consisting of the heavy chain amino acid sequence of antibody 13.1.2 (SEQ ID NO: 138), 131 (SEQ ID NO: 2), 170 (SEQ ID NO: 4), 150 (SEQ ID NO: 5), 095 (SEQ ID NO: 7), 250 (SEQ ID NO: 9), 139 (SEQ ID NO: 10), 211 (SEQ ID NO: 12), 124 (SEQ ID NO: 13), 318 (SEQ ID NO: 15), 342 (SEQ ID NO: 16), and 333 (SEQ ID NO: 17).

US20090156790 (Amgen)

For example, antibody having heavy chain polypeptide and a light chain polypeptide, wherein at least one of the heavy or light chain polypeptides comprises an amino acid sequence that is at least 90% identical to the amino acid sequence selected from the group consisting of: SEQ ID NO: 2, SEQ ID NO: 19, SEQ ID NO: 142, SEQ ID NO: 144, and any combination thereof.

US20090155282, US20050059087 and US20050053608 (Amgen)

For example, an antibody heavy chain amino acid sequence selected from the group consisting of the heavy chain amino acid sequence of antibody 13.1.2 (SEQ ID NO: 138), 131 (SEQ ID NO: 2), 170 (SEQ ID NO: 4), 150 (SEQ ID NO: 5), 095 (SEQ ID NO: 7), 250 (SEQ ID NO: 9), 139 (SEQ ID NO: 10), 211 (SEQ ID NO: 12), 124 (SEQ ID NO: 13), 318 (SEQ ID NO: 15), 342 (SEQ ID NO: 16), and 333 (SEQ ID NO: 17).

MR1-1 (U.S. Pat. No. 7,129,332; Duke)

For example, a variant antibody having the sequence of SEQ ID NO.18 with the substitutions S98P-T99Y in the CDR3 VH, and F92W in CDR3 VL.

L8A4, H10, Y10 (Wikstrand C J., et al *Cancer Res.* 1995 Jul. 15; 55(14):3140-8; Duke)

US20090311803 (Harvard University)

For example, SEQ ID NO:9 for antibody heavy chain variable region, and SEQ ID NO: 3 for light chain variable region amino acid sequences US20070274991 (EMD72000, also known as matuzumab; Harvard University)

For example, SEQ ID NOs: 3 & 9 for light chain and heavy chain respectively

U.S. Pat. No. 6,129,915 (Schering)

For example, SEQ. ID NOs: 1, 2, 3, 4, 5 and 6.

mAb CH12—Wang H., et al *FASEB J.* 2012 January; 26(1):73-80 (Shanghai Cancer Institute).

RAbDMvIII—Gupta P., et al *BMC Biotechnol.* 2010 Oct. 7; 10:72 (Stanford University Medical Center).

mAb Ua30—Ohman L., et al Tumour Biol. 2002 March-April; 23(2):61-9 (Uppsala University).

Han D G., et al *Nan Fang Yi Ke Da Xue Xue Bao.* 2010 January; 30(1):25-9 (Xi'an Jiaotong University).

(46) CD33 (CD33 Molecule)

Nucleotide

Genbank accession no. M_23197

Genbank version no. NM_23197.1 GI:180097

Genbank record update date: Jun. 23, 2010 08:47 AM

Polypeptide

Genbank accession no. AAA51948

Genbank version no. AAA51948.1 GI:188098

Genbank record update date: Jun. 23, 2010 08:47 AM

Cross-References

Simmons D., et al *J. Immunol.* 141 (8), 2797-2800 (1988)

Other Information

Official Symbol: CD33

Other Aliases: SIGLEC-3, SIGLEC3, p67

Other Designations: CD33 antigen (gp67); gp67; myeloid cell surface antigen CD33; sialic acid binding Ig-like lectin 3; sialic acid-binding Ig-like lectin Antibodies H195 (Lintuzumab)—Raza A., et al *Leuk Lymphoma.* 2009 August; 50(8):1336-44; U.S. Pat. No. 6,759,045 (Seattle Genetics/Immunomedics)

mAb OKT9: Sutherland, D. R. et al. *Proc Natl Acad Sci USA* 78(7): 4515-4519 1981, Schneider, C., et al *J Biol Chem* 257, 8516-8522 (1982)

mAb E6: Hoogenboom, H. R., et al *J Immunol* 144, 3211-3217 (1990)

U.S. Pat. No. 6,590,088 (Human Genome Sciences)

For example, SEQ ID NOs: 1 and 2 and ATCC accession no. 97521

U.S. Pat. No. 7,557,189 (Immunogen)

For example, an antibody or fragment thereof comprising a heavy chain variable region which comprises three CDRs having the amino acid sequences of SEQ ID NOs:1-3 and a light chain variable region comprising three CDRs having the amino acid sequences of SEQ ID NOs:4-6.

(47) CD19 (CD 19 Molecule)

Nucleotide

Genbank accession no. NM_001178098

Genbank version no. NM_001178098.1 GI:296010920

Genbank record update date: Sep. 10, 2012 12:43 AM

Polypeptide

Genbank accession no. NP_001171569

Genbank version no. NP_001171569.1 GI:296010921

Genbank record update date: Sep. 10, 2012 12:43 AM

Cross-References
Tedder T F., et al J. Immunol. 143 (2): 712-7 (1989)
Other Information
Official Symbol: CD19
Other Aliases: B4, CVID3
Other Designations: B-lymphocyte antigen CD19; B-lymphocyte surface antigen B4; T-cell surface antigen Leu-12; differentiation antigen CD19
Antibodies
Immunogen: HuB4—Al-Katib A M., et al *Clin Cancer Res.* 2009 Jun. 15; 15(12):4038-45.
4G7: Kügler M., et al *Protein Eng Des Sel.* 2009 March; 22(3):135-47
  For example, sequences in FIG. 3 of Knappik, A. et al. J Mol Biol 2000 February; 296(1):57-86
AstraZeneca/MedImmune: MEDI-551—Herbst R., et al *J Pharmacol Exp Ther.* 2010 October; 335(1):213-22
Glenmark Pharmaceuticals: GBR-401—Hou S., et al Mol Cancer Ther Nov. 10, 2011 (Meeting Abstract Supplement) C164
  U.S. Pat. No. 7,109,304 (Immunomedics)
  For example, an antibody comprising the sequence of hA19Vk (SEQ ID NO:7) and the sequence of hA19VH (SEQ ID NO:10)
  U.S. Pat. No. 7,902,338 (Immunomedics)
  For example, an antibody or antigen-binding fragment thereof that comprises the light chain complementarity determining region CDR sequences CDR1 of SEQ ID NO: 16 (KASQSVDYDGDSYLN); CDR2 of SEQ ID NO: 17 (DASNLVS); and CDR3 of SEQ ID NO: 18 (QQSTEDPWT) and the heavy chain CDR sequences CDR1 of SEQ ID NO: 19 (SYWMN); CDR2 of SEQ ID NO: 20 (QIWPGDGDTNYNGKFKG) and CDR3 of SEQ ID NO: 21 (RETTTVGRYYYAMDY) and also comprises human antibody framework (FR) and constant region sequences with one or more framework region amino acid residues substituted from the corresponding framework region sequences of the parent murine antibody, and wherein said substituted FR residues comprise the substitution of serine for phenylalanine at Kabat residue 91 of the heavy chain variable region.
Medarex: MDX-1342—Cardarelli P M., et al *Cancer Immunol Immunother.* 2010 February; 59(2):257-65.
MorphoSys/Xencor: MOR-208/XmAb-5574—Zalevsky J., et al *Blood.* 2009 Apr. 16; 113(16):3735-43
  U.S. Pat. No. 7,968,687 (Seattle Genetics)
  An antibody or antigen-binding fragment comprising a heavy chain variable domain comprising the amino acid sequence of SEQ ID NO:9 and a light chain variable domain comprising the amino acid sequence of SEQ ID NO: 24.
4G7 chim—Lang P., et al Blood. 2004 May 15; 103(10): 3982-5 (University of Tübingen) For example, FIG. 6 and SEQ ID No: 80 of US20120082664
Zhejiang University School of Medicine: 2E8—Zhang J., et al J Drug Target. 2010 November; 18(9):675-8
(48) IL2RA (Interleukin 2 Receptor, Alpha); NCBI Reference Sequence: NM_000417.2);
Nucleotide
Genbank accession no. NM_000417
Genbank version no. NM_000417.2 GI:269973860
Genbank record update date: Sep. 9, 2012 04:59 PM
Polypeptide
Genbank accession no. NP_000408
Genbank version no. NP_000408.1 GI:4557667
Genbank record update date: Sep. 9, 2012 04:59 PM
Cross-References
Kuziel W. A., et al *J. Invest. Dermatol.* 94 (6 SUPPL), 27S-32S (1990)
Other Information
Official Symbol: IL2RA
Other Aliases: RP11-536K7.1, CD25, IDDM10, IL2R, TCGFR
Other Designations: FIL-2 receptor subunit alpha; IL-2-RA; IL-2R subunit alpha; IL2-RA; TAC antigen; interleukin-2 receptor subunit alpha; p55
Antibodies
U.S. Pat. No. 6,383,487 (Novartis/UCL: Baxilisimab [Simulect])
U.S. Pat. No. 6,521,230 (Novartis/UCL: Baxilisimab [Simulect])
  For example, an antibody having an antigen binding site comprises at least one domain which comprises CDR1 having the amino acid sequence in SEQ. ID. NO: 7, CDR2 having the amino acid sequence in SEQ. ID. NO: 8, and CDR3 having the amino acid sequence in SEQ. ID. NO: 9; or said CDR1, CDR2 and CDR3 taken in sequence as a whole comprise an amino acid sequence which is at least 90% identical to SEQ. ID. NOs: 7, 8 and 9 taken in sequence as a whole.
Daclizumab—Rech A J., et al Ann N Y Acad Sci. 2009 September; 1174:99-106 (Roche)
(49) AXL (AXL Receptor Tyrosine Kinase)
Nucleotide
Genbank accession no. M76125
Genbank version no. M76125.1 GI:292869
Genbank record update date: Jun. 23, 2010 08:53 AM
Polypeptide
Genbank accession no. AAA61243
Genbank version no. AAA61243.1 GI:29870
Genbank record update date: Jun. 23, 2010 08:53 AM
Cross-References
O'Bryan J. P., et al *Mol. Cell. Biol.* 11 (10), 5016-5031 (1991); Bergsagel P. L., et al *J. Immunol.* 148 (2), 590-596 (1992)
Other Information
Official Symbol: AXL
Other Aliases: JTK11, UFO
Other Designations: AXL oncogene; AXL transforming sequence/gene; oncogene AXL; tyrosine-protein kinase receptor UFO
Antibodies
YW327.652—Ye X., et al *Oncogene.* 2010 Sep. 23; 29(38):5254-64. (Genentech)
BergenBio: BGB324 (http://www.bergenbio.com/BGB324)
(50) CD30-TNFRSF8 (Tumor Necrosis Factor Receptor Superfamily, Member 8)
Nucleotide
Genbank accession no. M83554
Genbank version no. M83554.1 GI:180095
Genbank record update date: Jun. 23, 2010 08:53 AM
Polypeptide
Genbank accession no. AAA51947
Genbank version no. AAA51947.1 GI:180096
Genbank record update date: Jun. 23, 2010 08:53 AM
Cross-References
Durkop H., et al *Cell* 68 (3), 421-427 (1992)
Other Information
Official Symbol: TNFRSF8
Other Aliases: CD30, D1S166E, Ki-1

Other Designations: CD30L receptor; Ki-1 antigen; cytokine receptor CD30; lymphocyte activation antigen CD30; tumor necrosis factor receptor superfamily member 8

(51) BCMA (B-Cell Maturation Antigen)—TNFRSF17 (Tumor Necrosis Factor Receptor Superfamily, Member 17)
Nucleotide
Genbank accession no. Z29574
Genbank version no. Z29574.1 GI:471244
Genbank record update date: Feb. 2, 2011 10:40 AM
Polypeptide
Genbank accession no. CAA82690
Genbank version no. CAA82690.1 GI:471245
Genbank record update date: Feb. 2, 2011 10:40 AM
Cross-References
Laabi Y., et al Nucleic Acids Res. 22 (7), 1147-1154 (1994)
Other Information
Official Symbol: TNFRSF17
Other Aliases: BCM, BCMA, CD269
Other Designations: B cell maturation antigen; B-cell maturation factor; B-cell maturation protein; tumor necrosis factor receptor superfamily member 17

(52) CT Ags—CTA (Cancer Testis Antigens)
Cross-References
Fratta E., et al. *Mol Oncol.* 2011 April; 5(2):164-82; Lim S H., at al *Am J Blood Res.* 2012; 2(1):29-35.

(53) CD174 (Lewis Y)—FUT3 (Fucosyltransferase 3 (Galactoside 3(4)-L-Fucosyltransferase, Lewis Blood Group)
Nucleotide
Genbank accession no. NM000149
Genbank version no. NM000149.3 GI:148277008
Genbank record update date: Jun. 26, 2012 04:49 PM
Polypeptide
Genbank accession no. NP_000140
Genbank version no. NP_000140.1 GI:4503809
Genbank record update date: Jun. 26, 2012 04:49 PM
Cross-References
Kukowska-Latallo, J. F., et al *Genes Dev.* 4 (8), 1288-1303 (1990)
Other Information
Official Symbol: FUT3
Other Aliases: CD174, FT3B, FucT-III, LE, Les
Other Designations: Lewis F T; alpha-(1,3/1,4)-fucosyltransferase; blood group Lewis alpha-4-fucosyltransferase; fucosyltransferase III; galactoside 3(4)-L-fucosyltransferase

(54) CLEC14A (C-Type Lectin Domain Family 14, Member A; Genbank Accession No. NM175060)
Nucleotide
Genbank accession no. NM175060
Genbank version no. NM175060.2 GI:371123930
Genbank record update date: Apr. 1, 2012 03:34 PM
Polypeptide
Genbank accession no. NP_778230
Genbank version no. NP_778230.1 GI:28269707
Genbank record update date: Apr. 1, 2012 03:34 PM
Other Information
Official Symbol: CLEC14A
Other Aliases: UNQ236/PRO269, C14orf27, CEG1, EGFR-5
Other Designations: C-type lectin domain family 14 member A; CIECT and EGF-like domain containing protein; epidermal growth factor receptor 5

(55) GRP78—HSPA5 (Heat Shock 70 kDa Protein 5 (Glucose-Regulated Protein, 78 kDa)
Nucleotide
Genbank accession no. NM005347
Genbank version no. NM005347.4 GI:305855105
Genbank record update date: Sep. 30, 2012 01:42 PM
Polypeptide
Genbank accession no. NP_005338
Genbank version no. NP_005338.1 GI:16507237
Genbank record update date: Sep. 30, 2012 01:42 PM
Cross-References
Ting J., et al *DNA* 7 (4), 275-286 (1988)
Other Information
Official Symbol: HSPA5
Other Aliases: BIP, GRP78, MIF2
Other Designations: 78 kDa glucose-regulated protein; endoplasmic reticulum lumenal Ca(2+)-binding protein grp78; immunoglobulin heavy chain-binding protein

(56) CD70 (CD70 Molecule) L08096
Nucleotide
Genbank accession no. L08096
Genbank version no. L08096.1 GI:307127
Genbank record update date: Jun. 23, 2012 08:54 AM
Polypeptide
Genbank accession no. AAA36175
Genbank version no. AAA36175.1 GI:307128
Genbank record update date: Jun. 23, 2012 08:54 AM
Cross-References
Goodwin R. G., et al *Cell* 73 (3), 447-456 (1993)
Other Information
Official Symbol: CD70
Other Aliases: CD27L, CD27LG, TNFSF7
Other Designations: CD27 ligand; CD27-L; CD70 antigen; Ki-24 antigen; surface antigen CD70; tumor necrosis factor (ligand) superfamily, member 7; tumor necrosis factor ligand superfamily member 7
Antibodies
MDX-1411 against CD70 (Medarex)
h1F6 (Oflazoglu, E., et al, Clin Cancer Res. 2008 Oct. 1; 14(19):6171-80; Seattle Genetics)
For example, see US20060083736 SEQ ID NOs: 1, 2, 11 and 12 and FIG. 1.

(57) Stem Cell Specific Antigens. For Example:
5T4 (see entry (63) below)
CD25 (see entry (48) above)
CD32
  Polypeptide
    Genbank accession no. ABK42161
    Genbank version no. ABK42161.1 GI:117616286
    Genbank record update date: Jul. 25, 2007 03:00 PM
LGR5/GPR49
  Nucleotide
    Genbank accession no. NM_003667
    Genbank version no. NM_003667.2 GI:24475886
    Genbank record update date: Jul. 22, 2012 03:38 PM
  Polypeptide
    Genbank accession no. NP_003658
    Genbank version no. NP_003658.1 GI:4504379
    Genbank record update date: Jul. 22, 2012 03:38 PM
Prominin/CD133
  Nucleotide
    Genbank accession no. NM_006017
    Genbank version no. NM_006017.2 GI:224994187
    Genbank record update date: Sep. 30, 2012 01:47 PM
  Polypeptide
    Genbank accession no. NP_006008
    Genbank version no. NP_006008.1 GI:5174387
    Genbank record update date: Sep. 30, 2012 01:47 PM

(58) ASG-5

Cross-References (Smith L. M., et. al *AACR* 2010 *Annual Meeting* (abstract #2590); Gudas J. M., et. al. *AACR* 2010 *Annual Meeting* (abstract #4393)

Antibodies

Anti-AGS-5 Antibody: M6.131 (Smith, L. M., et. al *AACR* 2010 *Annual Meeting* (abstract #2590)

(59) ENPP3 (Ectonucleotide Pyrophosphatase/Phosphodiesterase 3)

Nucleotide

Genbank accession no. AF005632

Genbank version no. AF005632.2 GI:4432589

Genbank record update date: Mar. 10, 2010 09:41 PM

Polypeptide

Genbank accession no. AAC51813

Genbank version no. AAC51813.1 GI:2465540

Genbank record update date: Mar. 10, 2010 09:41 PM

Cross-References

Jin-Hua P., et al *Genomics* 45 (2), 412-415 (1997)

Other Information

Official Symbol: ENPP3

Other Aliases: RP5-988G15.3, B10, CD203c, NPP3, PD-IBETA, PDNP3

Other Designations: E-NPP 3; dJ1005H11.3 (phosphodiesterase I/nucleotide pyrophosphatase 3); dJ914N13.3 (phosphodiesterase I/nucleotide pyrophosphatase 3); ectonucleotide pyrophosphatase/phosphodiesterase family member 3; gp130RB13-6; phosphodiesterase I beta; phosphodiesterase I/nucleotide pyrophosphatase 3; phosphodiesterase-I beta

(60) PRR4 (Proline Rich 4 (Lacrimal))

Nucleotide

Genbank accession no. NM_007244

Genbank version no. NM_007244.2 GI:154448885

Genbank record update date: Jun. 28, 2012 12:39 PM

Polypeptide

Genbank accession no. NP_009175

Genbank version no. NP_009175.2 GI:154448886

Genbank record update date: Jun. 28, 2012 12:39 PM

Cross-References

Dickinson D. P., et al *Invest. Ophthalmol. Vis. Sci.* 36 (10), 2020-2031 (1995)

Other Information

Official Symbol: PRR4

Other Aliases: LPRP, PROL4

Other Designations: lacrimal proline-rich protein; nasopharyngeal carcinoma-associated proline-rich protein 4; proline-rich polypeptide 4; proline-rich protein 4

(61) GCC—GUCY2C (Guanylate Cyclase 2C (Heat Stable Enterotoxin Receptor)

Nucleotide

Genbank accession no. NM_004963

Genbank version no. NM_004963.3 GI:222080082

Genbank record update date: Sep. 2, 2012 01:50 PM

Polypeptide

Genbank accession no. NP_004954

Genbank version no. NP_004954.2 GI:222080083

Genbank record update date: Sep. 2, 2012 01:50 PM

Cross-References

De Sauvage F. J., et al *J. Biol. Chem.* 266 (27), 17912-17918 (1991); Singh S., et al *Biochem. Biophys. Res. Commun.* 179 (3), 1455-1463 (1991)

Other Information

Official Symbol: GUCY2C

Other Aliases: DIAR6, GUC2C, MUCIL, STAR

Other Designations: GC-C; STA receptor; guanylyl cyclase C; hSTAR; heat-stable enterotoxin receptor; intestinal guanylate cyclase

(62) Liv-1—SLC39A6 (Solute Carrier Family 39 (Zinc Transporter), Member 6)

Nucleotide

Genbank accession no. U41060

Genbank version no. U41060.2 GI:12711792

Genbank record update date: Nov. 30, 2009 04:35 PM

Polypeptide

Genbank accession no. AAA96258

Genbank version no. AAA96258.2 GI:12711793

Genbank record update date: Nov. 30, 2009 04:35 PM

Cross-References

Taylor K M., et al *Biochim Biophys Acta.* 2003 Apr. 1; 1611(1-2):16-30

Other Information

Official Symbol: SLC39A6

Other Aliases: LIV-1

Other Designations: LIV-1 protein, estrogen regulated; ZIP-6; estrogen-regulated protein LIV-1; solute carrier family 39 (metal ion transporter), member 6; solute carrier family 39 member 6; zinc transporter ZIP6; zrt- and Irt-like protein 6

(63) 5T4, Trophoblast glycoprotein, TPBG—TPBG (Trophoblast Glycoprotein)

Nucleotide

Genbank accession no. AJ012159

Genbank version no. AJ012159.1 GI:3805946

Genbank record update date: Feb. 1, 2011 10:27 AM

Polypeptide

Genbank accession no. CAA09930

Genbank version no. CAA09930.1 GI:3805947

Genbank record update date: Feb. 1, 2011 10:27 AM

Cross-References

King K. W., et al *Biochim. Biophys. Acta* 1445 (3), 257-270 (1999)

Other Information

Official Symbol: TPBG

Other Aliases: 5T4, 5T4AG, M6P1

Other Designations: 5T4 oncofetal antigen; 5T4 oncofetal trophoblast glycoprotein; 5T4 oncotrophoblast glycoprotein

(64) CD56—NCMA1 (Neural Cell Adhesion Molecule 1)

Nucleotide

Genbank accession no. NM_000615

Genbank version no. NM_000615.6 GI:336285433

Genbank record update date: Sep. 23, 2012 02:32 PM

Polypeptide

Genbank accession no. NP_000606

Genbank version no. NP_000606.3 GI:94420689

Genbank record update date: Sep. 23, 2012 02:32 PM

Cross-References

Dickson, G., et al, *Cell* 50 (7), 1119-1130 (1987)

Other Information

Official Symbol: NCAM1

Other Aliases: CD56, MSK39, NCAM

Other Designations: antigen recognized by monoclonal antibody 5.1H11; neural cell adhesion molecule, NCAM Antibodies Immunogen: HuN901 (Smith S V., et al *Curr Opin Mol Ther.* 2005 August; 7(4):394-401)

For example, see humanized from murine N901 antibody. See FIG. 1b and 1e of Roguska, M. A., et al. Proc Natl Acad Sci USA February 1994; 91:969-973.

(65) CanAg (Tumor Associated Antigen CA242)
Cross-References
Haglund C., et al *Br J Cancer* 60:845-851, 1989; Baeckstrom D., et al *J Biol Chem* 266:21537-21547, 1991
Antibodies
huC242 (Tolcher A W et al., *J Clin Oncol.* 2003 Jan. 15; 21(2):211-22; Immunogen)
For example, see US20080138898A1 SEQ ID NO: 1 and 2

(66) FOLR1 (Folate Receptor 1)
Nucleotide
Genbank accession no. J05013
Genbank version no. J05013.1 GI:182417
Genbank record update date: Jun. 23, 2010 08:47 AM
Polypeptide
Genbank accession no. AAA35823
Genbank version no. AAA35823.1 GI:182418
Genbank record update date: Jun. 23, 2010 08:47 AM
Cross-References
Elwood P. C., et al *J. Biol. Chem.* 264 (25), 14893-14901 (1989)
Other Information
Official Symbol: FOLR1
Other Aliases: FBP, FOLR
Other Designations: FR-alpha; KB cells FBP; adult folate-binding protein; folate binding protein; folate receptor alpha; folate receptor, adult; ovarian tumor-associated antigen MOv18
Antibodies
M9346A—Whiteman K R., et al *Cancer Res* Apr. 15, 2012; 72(8 Supplement): 4628 (Immunogen)

(67) GPNMB (Glycoprotein (Transmembrane) nmb)
Nucleotide
Genbank accession no. X76534
Genbank version no. X76534.1 GI:666042
Genbank record update date: Feb. 2, 2011 10:10 AM
Polypeptide
Genbank accession no. CAA54044
Genbank version no. CAA54044.1 GI:666043
Genbank record update date: Feb. 2, 2011 10:10 AM
Cross-References
Weterman M. A., et al *Int. J. Cancer* 60 (1), 73-81 (1995)
Other Information
Official Symbol: GPNMB
Other Aliases: UNQ1725/PRO9925, HGFIN, NMB
Other Designations: glycoprotein NMB; glycoprotein nmb-like protein; osteoactivin; transmembrane glycoprotein HGFIN; transmembrane glycoprotein NMB
Antibodies
Celldex Therapeutics: CR011 (Tse K F., et al *Clin Cancer Res.* 2006 Feb. 15; 12(4):1373-82)
For example, see EP1827492B1 SEQ ID NO: 22, 24, 26, 31, 33 and 35

(68) TIM-1—HAVCR1 (Hepatitis A Virus Cellular Receptor 1)
Nucleotide
Genbank accession no. AF043724
Genbank version no. AF043724.1 GI:2827453
Genbank record update date: Mar. 10, 2010 06:24 PM
Polypeptide
Genbank accession no. AAC39862
Genbank version no. AAC39862.1 GI:2827454
Genbank record update date: Mar. 10, 2010 06:24 PM
Cross-References
Feigelstock D., et al *J. Virol.* 72 (8), 6621-6628 (1998)
Other Information
Official Symbol: HAVCR1
Other Aliases: HAVCR, HAVCR-1, KIM-1, KIM1, TIM, TIM-1, TIM1, TIMD-1, TIMD1
Other Designations: T cell immunoglobin domain and mucin domain protein 1; T-cell membrane protein 1; kidney injury molecule 1

(69) RG-1/Prostate Tumor Target Mindin—Mindin/RG-1
Cross-References
Parry R., et al *Cancer Res.* 2005 Sep. 15; 65(18):8397-405

(70) 87-H4—VTCN1 (V-Set Domain Containing T Cell Activation Inhibitor 1
Nucleotide
Genbank accession no. BX648021
Genbank version no. BX648021.1 GI:34367180
Genbank record update date: Feb. 2, 2011 08:40 AM
Cross-References
Sica G L., et al *Immunity.* 2003 June; 18(6):849-61
Other Information
Official Symbol: VTCN1
Other Aliases: RP11-229A19.4, B7-H4, B7H4, B7S1, B7X, B7h.5, PRO1291, VCTN1
Other Designations: B7 family member, H4; B7 superfamily member 1; T cell costimulatory molecule B7x; T-cell costimulatory molecule B7x; V-set domain-containing T-cell activation inhibitor 1; immune costimulatory protein B7-H4

(71) PTK7 (PTK7 Protein Tyrosine Kinase 7)
Nucleotide
Genbank accession no. AF447176
Genbank version no. AF447176.1 GI:17432420
Genbank record update date: Nov. 28, 2008 01:51 PM
Polypeptide
Genbank accession no. AAL39062
Genbank version no. AAL39062.1 GI:17432421
Genbank record update date: Nov. 28, 2008 01:51 PM
Cross-References
Park S. K., et al *J. Biochem.* 119 (2), 235-239 (1996)
Other Information
Official Symbol: PTK7
Other Aliases: CCK-4, CCK4
Other Designations: colon carcinoma kinase 4; inactive tyrosine-protein kinase 7; pseudo tyrosine kinase receptor 7; tyrosine-protein kinase-like 7

(72) CD37 (CD37 Molecule)
Nucleotide
Genbank accession no. NM_001040031
Genbank version no. NM_001040031.1 GI:91807109
Genbank record update date: Jul. 29, 2012 02:08 PM
Polypeptide
Genbank accession no. NP_001035120
Genbank version no. NP_001035120.1 GI:91807110
Genbank record update date: Jul. 29, 2012 02:08 PM
Cross-References
Schwartz-Albiez R., et al *J. Immunol.* 140 (3), 905-914 (1988)
Other Information
Official Symbol: CD37
Other Aliases: GP52-40, TSPAN26
Other Designations: CD37 antigen; cell differentiation antigen 37; leukocyte antigen CD37; leukocyte surface antigen CD37; tetraspanin-26; tspan-26
Antibodies
Boehringer Ingelheim: mAb 37.1 (Heider K H., et al *Blood.* 2011 Oct. 13; 118(15):4159-68)
Trubion: CD37-SMIP (G28-1 scFv-Ig) ((Zhao X., et al *Blood.* 2007; 110: 2569-2577)
For example, see US20110171208A1 SEQ ID NO: 253
Immunogen: K7153A (Deckert J., et al *Cancer Res* Apr. 15, 2012; 72(8 Supplement): 4625)

(73) CD138—SDC1 (Syndecan 1)
Nucleotide
Genbank accession no. AJ551176
Genbank version no. AJ551176.1 GI:29243141
Genbank record update date: Feb. 1, 2011 12:09 PM
Polypeptide
Genbank accession no. CAD80245
Genbank version no. CAD80245.1 GI:29243142
Genbank record update date: Feb. 1, 2011 12:09 PM
Cross-References
O'Connell F P., et al *Am J Clin Pathol.* 2004 February; 121(2):254-63
Other Information
Official Symbol: SDC1
Other Aliases: CD138, SDC, SYND1, syndecan
Other Designations: CD138 antigen; heparan sulfate proteoglycan fibroblast growth factor receptor; syndecan proteoglycan 1; syndecan-1
Antibodies
Biotest: chimerized MAb (nBT062)—(Jagannath S., et al Poster *ASH* #3060, 2010; WIPO Patent Application WO/2010/128087)
  For example, see US20090232810 SEQ ID NO: 1 and 2
  Immunogen: B-B4 (Tassone P., et al *Blood* 104_3688-3696)
  For example, see US20090175863A1 SEQ ID NO: 1 and 2

(74) CD74 (CD74 Molecule, Major Histocompatibility Complex, Class II Invariant Chain)
Nucleotide
Genbank accession no. NM_004355
Genbank version no. NM_004355.1 GI:343403784
Genbank record update date: Sep. 23, 2012 02:30 PM
Polypeptide
Genbank accession no. NP_004346
Genbank version no. NP_004346.1 GI:10835071
Genbank record update date: Sep. 23, 2012 02:30 PM
Cross-References
Kudo, J., et al *Nucleic Acids Res.* 13 (24), 8827-8841 (1985)
Other Information
Official Symbol: CD74
Other Aliases: DHLAG, HLADG, II, Ia-GAMMA
Other Designations: CD74 antigen (invariant polypeptide of major histocompatibility complex, class II antigen-associated); HLA class II histocompatibility antigen gamma chain; HLA-DR antigens-associated invariant chain; HLA-DR-gamma; Ia-associated invariant chain; MHC HLA-DR gamma chain; gamma chain of class II antigens; p33
Antibodies
Immunomedics: hLL1 (Milatuzumab,)—Berkova Z., et al *Expert Opin Investig Drugs.* 2010 January; 19(1):141-9)
  For example, see US20040115193 SEQ ID NOs: 19, 20, 21, 22, 23 and 24
  Genmab: HuMax-CD74 (see website)

(75) Claudins—CLs (Claudins)
Cross-References
Offner S., et al *Cancer Immunol Immunother.* 2005 May; 54(5):431-45, Suzuki H., et al *Ann N Y Acad Sci.* 2012 July; 1258:65-70)
In humans, 24 members of the family have been described—see literature reference.

(76) EGFR (Epidermal Growth Factor Receptor)
Nucleotide
Genbank accession no. NM_005228
Genbank version no. NM_005228.3 GI:41927737
Genbank record update date: Sep. 30, 2012 01:47 PM
Polypeptide
Genbank accession no. NP_005219
Genbank version no. NP_005219.2 GI:29725609
Genbank record update date: Sep. 30, 2012 01:47 PM
Cross-References
Dhomen N S., et al *Crit Rev Oncog.* 2012; 17(1):31-50
Other Information
Official Symbol: EGFR
Other Aliases: ERBB, ERBB1, HER1, PIG61, mENA
Other Designations: avian erythroblastic leukemia viral (v-erb-b) oncogene homolog; cell growth inhibiting protein 40; cell proliferation-inducing protein 61; proto-oncogene c-ErbB-1; receptor tyrosine-protein kinase erbB-1
Antibodies
BMS: Cetuximab (Erbitux)—Broadbridge V T., et al *Expert Rev Anticancer Ther.* 2012 May; 12(5):555-65.
  For example, see U.S. Pat. No. 6,217,866—ATTC deposit No. 9764.
Amgen: Panitumumab (Vectibix)—Argiles G., et al *Future Oncol.* 2012 April; 8(4):373-89
  For example, see U.S. Pat. No. 6,235,883 SEQ ID NOs: 23-38.
Genmab: Zalutumumab—Rivera F., et al *Expert Opin Biol Ther.* 2009 May; 9(5):667-74.
YM Biosciences: Nimotuzumab—Ramakrishnan M S., et al *MAbs.* 2009 January-February; 1(1):41-8.
  For example, see U.S. Pat. No. 5,891,996 SEQ ID NOs: 27-34.

(77) Her3 (ErbB3)—ERBB3 (v-erb-b2 Erythroblastic Leukemia Viral Oncogene Homolog 3 (Avian))
Nucleotide
Genbank accession no. M34309
Genbank version no. M34309.1 GI:183990
Genbank record update date: Jun. 23, 2010 08:47 PM
Polypeptide
Genbank accession no. AAA35979
Genbank version no. AAA35979.1 GI:306841
Genbank record update date: Jun. 23, 2010 08:47 PM
Cross-References
Plowman, G. D., et al., *Proc. Natl. Acad. Sci. U.S.A.* 87 (13), 4905-4909 (1990)
Other Information
Official Symbol: ERBB3
Other Aliases: ErbB-3, HER3, LCCS2, MDA-BF-1, c-erbB-3, c-erbB3, erbB3-S, p180-ErbB3, p45-sErbB3, p85-sErbB3
Other Designations: proto-oncogene-like protein c-ErbB-3; receptor tyrosine-protein kinase erbB-3; tyrosine kinase-type cell surface receptor HER3
Antibodies
Merimack Pharma: MM-121 (Schoeberl B., et al *Cancer Res.* 2010 Mar. 15; 70(6):2485-2494)
  For example, see US2011028129 SEQ ID NOs: 1, 2, 3, 4, 5, 6, 7 and 8.

(78) RON—MST1R (Macrophage Stimulating 1 Receptor (C-Met-Related Tyrosine Kinase))
Nucleotide
Genbank accession no. X70040
Genbank version no. X70040.1 GI:36109
Genbank record update date: Feb. 2, 2011 10:17 PM
Polypeptide
Genbank accession no. CCA49634
Genbank version no. CCA49634.1 GI:36110
Genbank record update date: Feb. 2, 2011 10:17 PM
Cross-References
Ronsin C., et al *Oncogene* 8 (5), 1195-1202 (1993)
Other Information
Official Symbol: MST1R
Other Aliases: CD136, CDw136, PTK8, RON Other Designations: MSP receptor; MST1R variant RON30; MST1R variant RON62; PTK8 protein tyrosine kinase 8; RON variant E2E3; c-met-related tyrosine kinase; macrophage-stimulating protein receptor; p185-Ron; soluble RON variant 1; soluble RON variant 2; soluble RON variant 3; soluble RONvariant 4

(79) EPHA2 (EPH Receptor A2)
Nucleotide
Genbank accession no. BCO37166
Genbank version no. BCO37166.2 GI:33879863
Genbank record update date: Mar. 6, 2012 01:59 PM
Polypeptide
Genbank accession no. AAH37166
Genbank version no. AAH37166.1 GI:22713539
Genbank record update date: Mar. 6, 2012 01:59 PM
Cross-References
Strausberg R. L., et al *Proc. Natl. Acad. Sci. U.S.A.* 99 (26), 16899-16903 (2002)
Other Information
Official Symbol: EPHA2
Other Aliases: ARCC2, CTPA, CTPP1, ECK
Other Designations: ephrin type-A receptor 2; epithelial cell receptor protein tyrosine kinase; soluble EPHA2 variant 1; tyrosine-protein kinase receptor ECK
Antibodies
Medimmune: 1C1 (Lee J W., et al *Clin Cancer Res.* 2010 May 1; 16(9):2562-2570)
For example, see US20090304721A1 FIGS. 7 and 8.

(80) CD20-MS4A1 (Membrane-Spanning 4-Domains, Subfamily A, Member 1)
Nucleotide
Genbank accession no. M27394
Genbank version no. M27394.1 GI:179307
Genbank record update date: Nov. 30, 2009 11:16 AM
Polypeptide
Genbank accession no. AAA35581
Genbank version no. AAA35581.1 GI:179308
Genbank record update date: Nov. 30, 2009 11:16 AM
Cross-References
Tedder T. F., et al *Proc. Natl. Acad. Sci. U.S.A.* 85 (1), 208-212 (1988)
Other Information
Official Symbol: MS4A1
Other Aliases: B1, Bp35, CD20, CVID5, LEU-16, MS4A2, S7
Other Designations: B-lymphocyte antigen CD20; B-lymphocyte cell-surface antigen B1; CD20 antigen; CD20 receptor; leukocyte surface antigen Leu-16
Antibodies
Genentech/Roche: Rituximab—Abdulla N E., et al *BioDrugs.* 2012 Apr. 1; 26(2):71-82.
For example, see U.S. Pat. No. 5,736,137, ATCC deposit No. HB-69119.
GSK/Genmab: Ofatumumab—Nightingale G., et al *Ann Pharmacother.* 2011 October; 45(10):1248-55.
For example, see US20090169550A1 SEQ ID NOs: 2, 4 and 5.
Immunomedics: Veltuzumab—Goldenberg D M., et al *Leuk Lymphoma.* 2010 May; 51(5):747-55.
For example, see U.S. Pat. No. 7,919,273B2 SEQ ID NOs: 1, 2, 3, 4, 5 and 6.

(81) Tenascin C—TNC (Tenascin C)
Nucleotide
Genbank accession no. NM_002160
Genbank version no. NM_002160.3 GI:340745336
Genbank record update date: Sep. 23, 2012 02:33 PM
Polypeptide
Genbank accession no. NP_002151
Genbank version no. NP_002151.2 GI:153946395
Genbank record update date: Sep. 23, 2012 02:33 PM
Cross-References
Nies D. E., et al *J. Biol. Chem.* 266 (5), 2818-2823 (1991); Siri A., et al *Nucleic Acids Res.* 19 (3), 525-531 (1991)
Other Information
Official Symbol: TNC
Other Aliases: 150-225, GMEM, GP, HXB, JI, TN, TN-C
Other Designations: GP 150-225; cytotactin; glioma-associated-extracellular matrix antigen; hexabrachion (tenascin); myotendinous antigen; neuronectin; tenascin; tenascin-C isoform 14/AD1/16
Antibodies
Philogen: G11 (von Lukowicz T., et al *J Nucl Med.* 2007 April; 48(4):582-7) and F16 (Pedretti M., et al *Lung Cancer.* 2009 April; 64(1):28-33)
For example, see U.S. Pat. No. 7,968,685 SEQ ID NOs: 29, 35, 45 and 47.

(82) FAP (Fibroblast Activation Protein, Alpha)
Nucleotide
Genbank accession no. U09278
Genbank version no. U09278.1 GI:1888315
Genbank record update date: Jun. 23, 2010 09:22 AM
Polypeptide
Genbank accession no. AAB49652
Genbank version no. AAB49652.1 GI:1888316
Genbank record update date: Jun. 23, 2010 09:22 AM
Cross-References
Scanlan, M. J., et al *Proc. Natl. Acad. Sci. U.S.A.* 91 (12), 5657-5661 (1994)
Other Information
Official Symbol: FAP
Other Aliases: DPPIV, FAPA
Other Designations: 170 kDa melanoma membrane-bound gelatinase; integral membrane serine protease; seprase

(83) DKK-1 (Dickkopf 1 Homolog (*Xenopus laevis*)
Nucleotide
Genbank accession no. NM_012242
Genbank version no. NM_012242.2 GI:61676924
Genbank record update date: Sep. 30, 2012 01:48 PM
Polypeptide
Genbank accession no. NP_036374
Genbank version no. NP_036374.1 GI:7110719
Genbank record update date: Sep. 30, 2012 01:48 PM
Cross-References
Fedi P. et al *J. Biol. Chem.* 274 (27), 19465-19472 (1999)
Other Information
Official Symbol: DKK1
Other Aliases: UNQ492/PRO1008, DKK-1, SK
Other Designations: dickkopf related protein-1; dickkopf-1 like; dickkopf-like protein 1; dickkopf-related protein 1; hDkk-1
Antibodies
Novartis: BHQ880 (Fulciniti M., et al *Blood.* 2009 Jul. 9; 114(2):371-379)
For example, see US20120052070A1 SEQ ID NOs: 100 and 108.

(84) CD52 (CD52 Molecule)
Nucleotide
Genbank accession no. NM_001803
Genbank version no. NM_001803.2 GI:68342029
Genbank record update date: Sep. 30, 2012 01:48 PM
Polypeptide
Genbank accession no. NP_001794
Genbank version no. NP_001794.2 GI:68342030
Genbank record update date: Sep. 30, 2012 01:48 PM Cross-References
Xia M. Q., et al *Eur. J. Immunol.* 21 (7), 1677-1684 (1991)
Other Information
Official Symbol: CD52
Other Aliases: CDW52
Other Designations: CAMPATH-1 antigen; CD52 antigen (CAMPATH-1 antigen); CDW52 antigen (CAM PATH-1 antigen); cambridge pathology 1 antigen; epididymal secretory protein E5; he5; human epididymis-specific protein 5
Antibodies
Alemtuzumab (Campath)—Skoetz N., et al *Cochrane Database Syst Rev.* 2012 Feb. 15; 2:CD008078.
    For example, see Drugbank Acc. No. DB00087 (BIOD00109, BTD00109)

(85) CS1-SLAMF7 (SLAM Family Member 7)
Nucleotide
Genbank accession no. NM_021181
Genbank version no. NM_021181.3 GI:1993571
Genbank record update date: Jun. 29, 2012 11:24 AM
Polypeptide
Genbank accession no. NP_067004
Genbank version no. NP_067004.3 GI:19923572
Genbank record update date: Jun. 29, 2012 11:24 AM
Cross-References
Boles K. S., et al *Immunogenetics* 52 (3-4), 302-307 (2001)
Other Information
Official Symbol: SLAMF7
Other Aliases: UNQ576/PRO1138, 19A, CD319, CRACC, CS1
Other Designations: 19A24 protein; CD2 subset 1; CD2-like receptor activating cytotoxic cells; CD2-like receptor-activating cytotoxic cells; membrane protein FOAP-12; novel LY9 (lymphocyte antigen 9) like protein; protein 19A
Antibodies
BMS: elotuzumab/HuLuc63 (Benson D M., et al *J Clin Oncol.* 2012 Jun. 1; 30(16):2013-2015)
    For example, see US20110206701 SEQ ID NOs: 9, 10, 11, 12, 13, 14, 15 and 16.

(86) Endoglin—ENG (Endoglin)
Nucleotide
Genbank accession no. AF035753
Genbank version no. AF035753.1 GI:3452260
Genbank record update date: Mar. 10, 2010 06:36 PM
Polypeptide
Genbank accession no. AAC32802
Genbank version no. AAC32802.1 GI:3452261
Genbank record update date: Mar. 10, 2010 06:36 PM
Cross-References
Rius C., et al *Blood* 92 (12), 4677-4690 (1998)
Official Symbol: ENG
Other Information
Other Aliases: RP11-228B15.2, CD105, END, HHT1, ORW, ORW1
Other Designations: CD105 antigen

(87) Annexin A1—ANXA1 (Annexin A1)
Nucleotide
Genbank accession no. X05908
Genbank version no. X05908.1 GI:34387
Genbank record update date: Feb. 2, 2011 10:02 AM
Polypeptide
Genbank accession no. CCA29338
Genbank version no. CCA29338.1 GI:34388
Genbank record update date: Feb. 2, 2011 10:02 AM
Cross-References
Wallner B. P., et al *Nature* 320 (6057), 77-81 (1986)
Other Information
Official Symbol: ANXA1
Other Aliases: RP11-71A24.1, ANX1, LPC1
Other Designations: annexin I (lipocortin I); annexin-1; calpactin II; calpactin-2; chromobindin-9; lipocortin I; p35; phospholipase A2 inhibitory protein

(88) V-CAM (CD106)—VCAM1 (Vascular cell adhesion molecule 1)
Nucleotide
Genbank accession no. M60335
Genbank version no. M60335.1 GI:340193
Genbank record update date: Jun. 23, 2010 08:56 AM
Polypeptide
Genbank accession no. AAA61269
Genbank version no. AAA61269.1 GI:340194
Genbank record update date: Jun. 23, 2010 08:56 AM
Cross-References
Hession C., et al J. Biol. Chem. 266 (11), 6682-6685 (1991)
Other Information
Official Symbol VCAM1
Other Aliases: CD106, INCAM-100
Other Designations: CD106 antigen; vascular cell adhesion protein 1

| Antibody Sequences |
|---|
| Anti-Integrin αvβ6 |
| RHAB6.2<br>QVQLVQSGSELKKPGASVKISCKASGFAFTDSYMHWVRQAPGQGLEWMGW<br>IDPENGDTEYAPKFQGRFVFSLDTSVSTAYLQISSLKAEDTAVYYCTRGT<br>PTAVPNLRGDLQVLAQKVAGPYPFDYWGQGTLVTVSS |
| RHCB6.2<br>QVQLVQSGAEVKKPGASVKVSCKASGYTFIDSYMHWVRQAPGQRLEWMGW<br>IDPENGDTEYAPKFQGRVTITTDTSASTAYMELSSLRSEDTAVYYCARGT<br>PTAVPNLRGDLQVLAQKVAGPYPFDYWGQGTLVTVSS |
| RHF<br>QVQLVQSGAEVKKPGASVKVSCKASGFNFIDSYMHWVRQAPGQRLEWMGW<br>IDPENGDTEYAPKFQGRVTFTTDTSASTAYMELSSLRSEDTAVYYCNEGT<br>PTGPYYFDYWGQGTLVTVSS |
| RHFB6<br>QVQLVQSGAEVKKPGASVKVSCKASGFNFIDSYMHWVRQAPGQRLEWMGW<br>IDPENGDTEYAPKFQGRVTFTTDTSASTAYMELSSLRSEDTAVYYCNEGT<br>PTAVPNLRGDLQVLAQKVAGPYYFDYWGQGTLVTVSS |
| RHAY100bP<br>QVQLVQSGSELKKPGASVKISCKASGFAFTDSYMHWVRQAPGQGLEWMGW<br>IDPENGDTEYAPKFQGRFVFSLDTSVSTAYLQISSLKAEDTAVYYCTRGT<br>PTGPYPFDYWGQGTLVTVSSRKF |
| RKF<br>ENVLTQSPGTLSLSPGERATLSCSASSSVSYMHWFQQKPGQAPRLLIYST<br>SNLASGIPDRFSGSGSGTDFTLTISRLEPEDFAVYYCQQRSSYPLTFGGG<br>TKVEIK |
| RKFL36L50<br>ENVLTQSPGTLSLSPGERATLSCSASSSVSYMHWLQQKPGQAPRLLIYLT<br>SNLASGIPDRFSGSGSGTDFTLTISRLEPEDFAVYYCQQRSSYPLTFGGG<br>TKVEIK |
| RKC<br>EIVLTQSPGTLSLSPGERATLSCSASSSVSYMHWFQQKPGQARLLIYSTS<br>NLASGIPDRFSGSGSGTDFTLTISRLEPEDFAVYYCQQRSSYPLTFGGGT<br>KVEIK |
| Anti-CD33<br>CD33 Hum195 VH<br>QVQLVQSGAEVKKPGSSVKVSCKASGYTFTDYNMHWVRQAPGQGLEWIGY<br>IYPYNGGTGYNQKFKSKATITADESTNTAYMELSSLRSEDTAVYYCARGR<br>PAMDYWGQGTLVTVSS |

Antibody Sequences

CD33 Hum195 VK
DIQMTQSPSSLSASVGDRVTITCRASESVDNYGISFMNWFQQKPGKAPKL
LIYAASNQGSGVPSRFSGSGSGTDFTLTISSLQPDDFATYYCQQSKEVPW
TFGQGTKVEIK

Anti-CD19
CD19 B4 resurfaced VH
QVQLVQPGAEVVKPGASVKLSCKTSGYTFTSNWMHWVKQRPGQGLEWIGE
IDPSDSYTNYNQNFKGKAKLTVDKSTSTAYMEVSSLRSDDTAVYYCARGS
NPYYYAMDYWGQGTSVTVSS CD19 B4 resurfaced VK
EIVLTQSPAIMSASPGERVTMTCSASSGVNYMHWYQQKPGTSPRRWIYDT
SKLASGVPARFSGSGSGTSYSLTISSMEPEDAATYYCHQRGSYTFGGGTK
LEIK Anti-Her2
Herceptin VH chain
EVQLVESGGGLVQPGGSLRLSCAASGFNIKDTYIHWVRQAPGKGLEWVAR
IYPTNGYTRYADSVKGRFTISADTSKNTAYLQMNSLRAEDTAVYYCSRWG
GDGFYAMDYWGQGTLVTVSS Herceptin VL chain
DIQMTQSPSSLSASVGDRVTITCRASQDVNTAVAWYQQKPGKAPKLLIYS
ASFLYSGVPSRFSGSRSGTDFTLTISSLQPEDFATYYCQQHYTTPPTFGQ
GTKVEIK Anti-CD25
Simulect VK (also known as Basiliximab)
QIVSTQSPAIMSASPGEKVTMTCSASSSRSYMQWYQQKPGTSPKRWIYDT
SKLASGVPARFSGSGSGTSYSLTISSMEAEDAATYYCHQRSSYTFGGGTK
LEIK Simulect VH
QLQQSGTVLARPGASVKMSCKASGYSFTRYWMHWIKQRPGQGLEWIGAIY
PGNSDTSYNQKFEGKAKLTAVTSASTAYMELSSLTHEDSAVYYCSRDYGY
YFDFWGQGTTLTVSS Anti-PSMA
Deimmunised VH '1
EVQLVQSGPEVKKPGATVKISCKTSGYTFTEYTIHWVKQAPGKGLEWIGN
INPNNGGTTYNQKFEDKATLTVDKSTDTAYMELSSLRSEDTAVYYCAAGW
NFDYWGQGTLLTVSS Deimmunised VK '1
DIQMTQSPSSLSTSVGDRVTLTCKASQDVGTAVDWYQQKPGPSPKLLIYW
ASTRHTGIPSRFSGSGSGTDFTLTISSLQPEDFADYYCQQYNSYPLTFGP
GTKVDIK Deimmunised VH1 '5
EVKLVESGGGLVQPGGSMKLSCVASGFTFSNYWMNWVRQAPGKGLEWVAE
IRSQSNNFATHYAESVKGRVTISRDDSKSIVYLQMNNLRAEDTGVYYCTR
RWNNFWGQGTTVTVSS Deimmunised VH2 '5
EVKLVESGGGLVQPGGSLKLSCVASGFTFSNYWMNWVRQAPGKGLEWVAE
IRSQSNNFATHYAESVKGRVTISRDDSKSIVYLQMNNLRAEDTAVYYCTR
RWNNFWGQGTTVTVSS Deimmunised VH3 '5
EVQLVESGGGLVQPGGSLKLSCVASGFTFSNYWMNWVRQAPGKGLEWVAE
IRSQSNNFATHYAESVKGRVTISRDDSKSIVYLQMNNLRAEDTAVYYCTR
RWNNFWGQGTTVTVSS Deimmunised VH4 '5
EVQLVESGGGLVQPGGSLKLSCVASGFTFSNYWMNWVRQAPGKGLEWVAE
IRSQSNNFATHYAESVKGRFTISRDDSKSIVYLQMNNLRAEDTAVYYCTR
RWNNFWGQGTTVTVSS Deimmunised VK1 '5
NIVMTQFPSSMSASVGDRVTITCKASENVGTYVSWYQQKPDQSPKMLIYG
ASNRFTGVPDRFTGSGSGTADFTLTISSLQTEDLADYYCGQSYTFPYTFGQ
GTKLEMK Deimmunised VK2 '5
NIVMTQFPSSMSASVGDRVTITCKASENVGTYVSWYQQKPDQSPKMLIYG
ASNRFTGVPDRFSGSGSGTDFTLTISSLQAEDLADYYCGQSYTFPYTFGQ
GTKLEIK Deimmunised VK3 '5
NIQMTQFPSAMSASVGDRVTITCKASENVGTYVSWYQQKPDQSPKMLIYG
ASNRFTGVPDRFSGSGSGTDFTLTISSLQAEDLADYYCGQSYTFPYTFGQ
GTKLEIK Deimmunised VK4 '5
NIQMTQFPSAMSASVGDRVTITCKASENVGTYVSWYQQKPDQSPKMLIYG
ASNRFTGVPDRFSGSGSGTDFTLTISSLQAEDEADYYCGQSYTFPYTFGQ
GTKLEIK Deimmunised VK DI '5
NIVMTQFPKSMSASAGERMTLTCKASENVGTYVSWYQQKPTQSPKMLIYG
ASNRFTGVPDRFSGSGSGTDFILTISSVQAEDLVDYYCGQSYTFPYTFGG
GTKLEMK Deimmunised VH DI '5
EVKLEESGGGLVQPGGSMKISCVASGFTFSNYWMNWVRQSPEKGLEWVAE
IRSQSNNFATHYAESVKGRVIISRDDSKSSVYLQMNSLRAEDTAVYYCTR
RWNNFWGQGTTVTVSS Humanised RHA '5
EVQLVESGGGLVQPGGSLKLSCAASGFTFSNYWMNWVRQASGKGLEWVGE
IRSQSNNFATHYAESVKGRFTISRDDSKNTAYLQMNSLKTEDTAVYYCTR
RWNNFWGQGTTVTVSS Humanised RHB '5
EVKLVESGGGLVQPGGSLKLSCAASGFTFSNYWMNWVRQASGKGLEWVAE
IRSQSNNFATHYAESVKGRVIISRDDSKNTVYLQMNSLRTEDTAVYYCTR
RWNNFWGQGTTVTVSS Humanised RHC '5
EVQLVESGGGLVQPGGSLKLSCAASGFTFSNYWMNWVRQASGKGLEWVAE
IRSQSNNFATHYAESVKGRVIISRDDSKNTVYLQMNSLRTEDTAVYYCTR
RWNNFWGQGTTVTVSS Humanised RHD '5
EVKLVESGGGLVQPGGSLKLSCAASGFTFSNYWMNWVRQASGKGLEWVGE
IRSQSNNFATHYAESVKGRVIISRDDSKNTVYLQMNSLRTEDTAVYYCTR
RWNNFWGQGTTVTVSS Humanised RHE '5
EVKLVESGGGLVQPGGSLKLSCAASGFTFSNYWMNWVRQASGKGLEWVAE
IRSQSNNFATHYAESVKGRFTISRDDSKNTVYLQMNSLRTEDTAVYYCTR
RWNNFWGQGTTVTVSS Humanised RHF '5
EVKLVESGGGLVQPGGSLKLSCAASGFTFSNYWMNWVRQASGKGLEWVAE
IRSQSNNFATHYAESVKGRVIISRDDSKNTAYLQMNSLRTEDTAVYYCTR
RWNNFWGQGTTVTVSS Humanised RHG '5
EVKLVESGGGLVQPGGSLKLSCAASGFTFSNYWMNWVRQASGKGLEWVAE
IRSQSNNFATHYAESVKGRVIISRDDSKNTAYLQMNSLRTEDTAVYYCTR
RWNNFWGQGTTVTVSS Humanised RKA '5
DIQMTQSPSSVSASVGDRVTITCKASENVGTYVSWYQQKPGTAPKLLIYG
ASNRFTGVPSRFSGSGSATDFTLTINNLQPEDFATYYCGQSYTFPYTFGQ
GTKVEIK Humanised RKB '5
DIQMTQSPSSVSASVGDRVTITCKASENVGTYVSWYQQKPGTAPKLLIYG
ASNRFTGVPSRFSGSGSATDFTLTINNLQPEDFATYYCGQSYTFPYTFGQ
GTKVEIK Humanised RKC '5
DIQMTQSPSSVSASVGDRVTITCKASENVGTYVSWYQQKPGTAPKMLIYG
ASNRFTGVPSRFSGSGSATDFTLTINNLQPEDFATYYCGQSYTFPYTFGQ
GTKVEIK -continued Antibody Sequences Humanised RKD '5
DIQMTQSPSSVSASVGDRVTITCKASENVGTYVSWYQQKPGTAPKMLIYG
ASNRFTGVPSRFSGSGSATDFTLTINNLQPEDFATYYCGQSYTFPYTFGQ
GTKVEIK Humanised RKE '5
NIVMTQSPSSVSASVGDRVTITCKASENVGTYVSWYQQKPGTAPKLLIYG
ASNRFTGVPDRFTGSGSATDFILTINNLQPEDFATYYCGQSYTFPYTFGQ
GTKVEIK Humanised RKF '5
NIVMTQSPSSVSASVGDRVTITCKASENVGTYVSWYQQKPGTAPKMLIYG
ASNRFTGVPSRFSGSGSATDFILTINNLQPEDFATYYCGQSYTFPYTFGQ
GTKVEIK Humanised RKG '5
NIVMTQSPSSVSASVGDRVTITCKASENVGTYVSWYQQKPGTAPKMLIYG
ASNRFTGVPDRFTGSGSATDFTLTINNLQPEDFATYYCGQSYTFPYTFGQ
GTKVEIK The parent antibody may also be a fusion protein comprising an albumin-binding peptide (ABP) sequence (Dennis et al. (2002) "Albumin Binding As A General Strategy For Improving The Pharmacokinetics Of Proteins" *J Biol Chem.* 277:35035-35043; WO 01/45746). Antibodies of the invention include fusion proteins with ABP sequences taught by: (i) Dennis et al (2002) *J Biol Chem.* 277:35035-35043 at Tables III and IV, page 35038; (ii) US 2004/0001827 at [0076]; and (iii) WO 01/45746 at pages 12-13, and all of which are incorporated herein by reference.

In one embodiment, the antibody has been raised to target specific the tumour related antigen $\alpha_v\beta_6$.

The cell binding agent may be labelled, for example to aid detection or purification of the agent either prior to incorporation as a conjugate, or as part of the conjugate. The label may be a biotin label. In another embodiment, the cell binding agent may be labelled with a radioisotope.

Embodiments of the present invention include ConjA wherein the cell binding agent is selected from an antibody to any of the antigens discussed above.

Embodiments of the present invention include ConjB wherein the cell binding agent is selected from an antibody to any of the antigens discussed above.

Embodiments of the present invention include ConjA wherein the cell binding agent is selected from any of the antibodies discussed above.

Embodiments of the present invention include ConjB wherein the cell binding agent is selected from any of the antibodies discussed above.

The present invention may also relate to conjugates where the cell binding agent is selected from an antibody to any of the antigens discussed above and any of the antibodies discussed above linked to different drugs.

Drug Loading

The drug loading is the average number of PBD drugs per cell binding agent, e.g. antibody. Where the compounds of the invention are bound to cysteines, drug loading may range from 1 to 8 drugs (D) per cell binding agent, i.e. where 1, 2, 3, 4, 5, 6, 7, and 8 drug moieties are covalently attached to the cell binding agent. Compositions of conjgates include collections of cell binding agents, e.g. antibodies, conjugated with a range of drugs, from 1 to 8. Where the compounds of the invention are bound to lysines, drug loading may range from 1 to 80 drugs (D) per cell binding agent, although an upper limit of 40, 20, 10 or 8 may be preferred. Compositions of conjgates include collections of cell binding agents, e.g. antibodies, conjugated with a range of drugs, from 1 to 80, 1 to 40, 1 to 20, 1 to 10 or 1 to 8.

The average number of drugs per antibody in preparations of ADC from conjugation reactions may be characterized by conventional means such as UV, reverse phase HPLC, HIC, mass spectroscopy, ELISA assay, and electrophoresis. The quantitative distribution of ADC in terms of p may also be determined. By ELISA, the averaged value of p in a particular preparation of ADC may be determined (Hamblett et al (2004) Clin. Cancer Res. 10:7063-7070; Sanderson et al (2005) Clin. Cancer Res. 11:843-852). However, the distribution of p (drug) values is not discernible by the antibody-antigen binding and detection limitation of ELISA. Also, ELISA assay for detection of antibody-drug conjugates does not determine where the drug moieties are attached to the antibody, such as the heavy chain or light chain fragments, or the particular amino acid residues. In some instances, separation, purification, and characterization of homogeneous ADC where p is a certain value from ADC with other drug loadings may be achieved by means such as reverse phase HPLC or electrophoresis. Such techniques are also applicable to other types of conjugates.

For some antibody-drug conjugates, p may be limited by the number of attachment sites on the antibody. For example, an antibody may have only one or several cysteine thiol groups, or may have only one or several sufficiently reactive thiol groups through which a linker may be attached. Higher drug loading, e.g. p>5, may cause aggregation, insolubility, toxicity, or loss of cellular permeability of certain antibody-drug conjugates.

Typically, fewer than the theoretical maximum of drug moieties are conjugated to an antibody during a conjugation reaction. An antibody may contain, for example, many lysine residues that do not react with the drug-linker intermediate (D-L) or linker reagent. Only the most reactive lysine groups may react with an amine-reactive linker reagent. Also, only the most reactive cysteine thiol groups may react with a thiol-reactive linker reagent. Generally, antibodies do not contain many, if any, free and reactive cysteine thiol groups which may be linked to a drug moiety. Most cysteine thiol residues in the antibodies of the compounds exist as disulfide bridges and must be reduced with a reducing agent such as dithiothreitol (DTT) or TCEP, under partial or total reducing conditions. The loading (drug/antibody ratio) of an ADC may be controlled in several different manners, including: (i) limiting the molar excess of drug-linker intermediate (D-L) or linker reagent relative to antibody, (ii) limiting the conjugation reaction time or temperature, and (iii) partial or limiting reductive conditions for cysteine thiol modification.

Certain antibodies have reducible interchain disulfides, i.e. cysteine bridges. Antibodies may be made reactive for conjugation with linker reagents by treatment with a reducing agent such as DTT (dithiothreitol). Each cysteine bridge will thus form, theoretically, two reactive thiol nucleophiles. Additional nucleophilic groups can be introduced into antibodies through the reaction of lysines with 2-iminothiolane (Traut's reagent) resulting in conversion of an amine into a thiol. Reactive thiol groups may be introduced into the antibody (or fragment thereof) by engineering one, two, three, four, or more cysteine residues (e.g., preparing mutant antibodies comprising one or more non-native cysteine amino acid residues). U.S. Pat. No. 7,521,541 teaches engineering antibodies by introduction of reactive cysteine amino acids.

Cysteine amino acids may be engineered at reactive sites in an antibody and which do not form intrachain or intermolecular disulfide linkages (Junutula, et al., 2008b Nature Biotech., 26(8):925-932; Dornan et al (2009) Blood 114 (13):2721-2729; U.S. Pat. No. 7,521,541; U.S. Pat. No. 7,723,485; WO2009/052249). The engineered cysteine thiols may react with linker reagents or the drug-linker reagents of the present invention which have thiol-reactive, electrophilic groups such as maleimide or alpha-halo amides to form ADC with cysteine engineered antibodies and the PBD drug moieties. The location of the drug moiety can thus be designed, controlled, and known. The drug loading can be controlled since the engineered cysteine thiol groups typically react with thiol-reactive linker reagents or drug-linker reagents in high yield. Engineering an IgG antibody to introduce a cysteine amino acid by substitution at a single site on the heavy or light chain gives two new cysteines on the symmetrical antibody. A drug loading near 2 can be achieved with near homogeneity of the conjugation product ADC.

Where more than one nucleophilic or electrophilic group of the antibody reacts with a drug-linker intermediate, or linker reagent followed by drug moiety reagent, then the resulting product is a mixture of ADC compounds with a distribution of drug moieties attached to an antibody, e.g. 1, 2, 3, etc. Liquid chromatography methods such as polymeric reverse phase (PLRP) and hydrophobic interaction (HIC) may separate compounds in the mixture by drug loading value. Preparations of ADC with a single drug loading value (p) may be isolated, however, these single loading value ADCs may still be heterogeneous mixtures because the drug moieties may be attached, via the linker, at different sites on the antibody.

Thus the antibody-drug conjugate compositions of the invention include mixtures of antibody-drug conjugate compounds where the antibody has one or more PBD drug moieties and where the drug moieties may be attached to the antibody at various amino acid residues.

In one embodiment, the average number of dimer pyrrolobenzodiazepine groups per cell binding agent is in the range 1 to 20. In some embodiments the range is selected from 1 to 8, 2 to 8, 2 to 6, 2 to 4, and 4 to 8.

In some embodiments, there is one dimer pyrrolobenzodiazepine group per cell binding agent.

Includes Other Forms

Unless otherwise specified, included in the above are the well known ionic, salt, solvate, and protected forms of these substituents. For example, a reference to carboxylic acid (—COOH) also includes the anionic (carboxylate) form (—COO$^-$), a salt or solvate thereof, as well as conventional protected forms. Similarly, a reference to an amino group includes the protonated form (—N$^+$HR$^1$R$^2$), a salt or solvate of the amino group, for example, a hydrochloride salt, as well as conventional protected forms of an amino group. Similarly, a reference to a hydroxyl group also includes the anionic form (—O$^-$), a salt or solvate thereof, as well as conventional protected forms.

Salts

It may be convenient or desirable to prepare, purify, and/or handle a corresponding salt of the active compound, for example, a pharmaceutically-acceptable salt. Examples of pharmaceutically acceptable salts are discussed in Berge, et al., *J. Pharm. Sci.*, 66, 1-19 (1977).

For example, if the compound is anionic, or has a functional group which may be anionic (e.g. —COOH may be —COO$^-$), then a salt may be formed with a suitable cation. Examples of suitable inorganic cations include, but are not limited to, alkali metal ions such as Na$^+$ and K$^+$, alkaline earth cations such as Ca$^{2+}$ and Mg$^{2+}$, and other cations such as Al$^{+3}$. Examples of suitable organic cations include, but are not limited to, ammonium ion (i.e. NH$_4^+$) and substituted ammonium ions (e.g. NH$_3$R$^+$, NH$_2$R$_2^+$, NHR$_3^+$, NR$_4^+$). Examples of some suitable substituted ammonium ions are those derived from: ethylamine, diethylamine, dicyclohexylamine, triethylamine, butylamine, ethylenediamine, ethanolamine, diethanolamine, piperazine, benzylamine, phenylbenzylamine, choline, meglumine, and tromethamine, as well as amino acids, such as lysine and arginine. An example of a common quaternary ammonium ion is N(CH$_3$)$_4^+$.

If the compound is cationic, or has a functional group which may be cationic (e.g. —NH$_2$ may be —NH$_3^+$), then a salt may be formed with a suitable anion. Examples of suitable inorganic anions include, but are not limited to, those derived from the following inorganic acids: hydrochloric, hydrobromic, hydroiodic, sulfuric, sulfurous, nitric, nitrous, phosphoric, and phosphorous.

Examples of suitable organic anions include, but are not limited to, those derived from the following organic acids: 2-acetyoxybenzoic, acetic, ascorbic, aspartic, benzoic, camphorsulfonic, cinnamic, citric, edetic, ethanedisulfonic, ethanesulfonic, fumaric, glucheptonic, gluconic, glutamic, glycolic, hydroxymaleic, hydroxynaphthalene carboxylic, isethionic, lactic, lactobionic, lauric, maleic, malic, methanesulfonic, mucic, oleic, oxalic, palmitic, pamoic, pantothenic, phenylacetic, phenylsulfonic, propionic, pyruvic, salicylic, stearic, succinic, sulfanilic, tartaric, toluenesulfonic, trifluoroacetic acid and valeric. Examples of suitable polymeric organic anions include, but are not limited to, those derived from the following polymeric acids: tannic acid, carboxymethyl cellulose.

Solvates

It may be convenient or desirable to prepare, purify, and/or handle a corresponding solvate of the active compound. The term "solvate" is used herein in the conventional sense to refer to a complex of solute (e.g. active compound, salt of active compound) and solvent. If the solvent is water, the solvate may be conveniently referred to as a hydrate, for example, a mono-hydrate, a di-hydrate, a tri-hydrate, etc.

The invention includes compounds where a solvent adds across the imine bond of the PBD moiety, which is illustrated below where the solvent is water or an alcohol (R$^A$OH, where R$^A$ is C$_{1-4}$ alkyl):

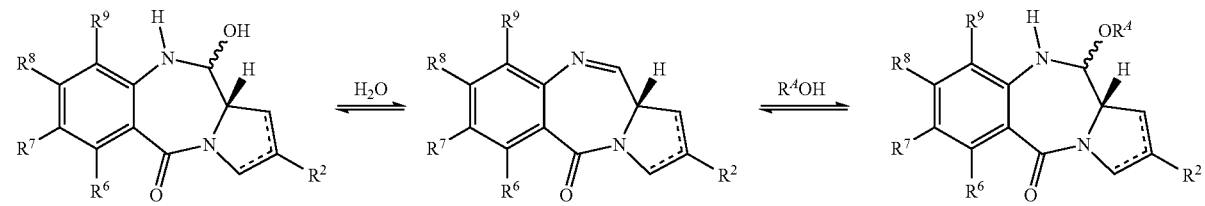

These forms can be called the carbinolamine and carbinolamine ether forms of the PBD (as described in the section relating to $R^{10}$ above). The balance of these equilibria depend on the conditions in which the compounds are found, as well as the nature of the moiety itself.

These particular compounds may be isolated in solid form, for example, by lyophilisation.

Isomers

Certain compounds of the invention may exist in one or more particular geometric, optical, enantiomeric, diastereomeric, epimeric, atropic, stereoisomeric, tautomeric, conformational, or anomeric forms, including but not limited to, cis- and trans-forms; E- and Z-forms; c-, t-, and r-forms; endo- and exo-forms; R-, S-, and meso-forms; D- and L-forms; d- and I-forms; (+) and (−) forms; keto-, enol-, and enolate-forms; syn- and anti-forms; synclinal- and anticlinal-forms; α- and β-forms; axial and equatorial forms; boat-, chair-, twist-, envelope-, and halfchair-forms; and combinations thereof, hereinafter collectively referred to as "isomers" (or "isomeric forms").

The term "chiral" refers to molecules which have the property of non-superimposability of the mirror image partner, while the term "achiral" refers to molecules which are superimposable on their mirror image partner.

The term "stereoisomers" refers to compounds which have identical chemical constitution, but differ with regard to the arrangement of the atoms or groups in space.

"Diastereomer" refers to a stereoisomer with two or more centers of chirality and whose molecules are not mirror images of one another. Diastereomers have different physical properties, e.g. melting points, boiling points, spectral properties, and reactivities. Mixtures of diastereomers may separate under high resolution analytical procedures such as electrophoresis and chromatography.

"Enantiomers" refer to two stereoisomers of a compound which are non-superimposable mirror images of one another.

Stereochemical definitions and conventions used herein generally follow S. P. Parker, Ed., *McGraw-Hill Dictionary of Chemical Terms* (1984) McGraw-Hill Book Company, New York; and Eliel, E. and Wilen, S., "Stereochemistry of Organic Compounds", John Wiley & Sons, Inc., New York, 1994. The compounds of the invention may contain asymmetric or chiral centers, and therefore exist in different stereoisomeric forms. It is intended that all stereoisomeric forms of the compounds of the invention, including but not limited to, diastereomers, enantiomers and atropisomers, as well as mixtures thereof such as racemic mixtures, form part of the present invention. Many organic compounds exist in optically active forms, i.e., they have the ability to rotate the plane of plane-polarized light. In describing an optically active compound, the prefixes D and L, or R and S, are used to denote the absolute configuration of the molecule about its chiral center(s). The prefixes d and I or (+) and (−) are employed to designate the sign of rotation of plane-polarized light by the compound, with (−) or I meaning that the compound is levorotatory. A compound prefixed with (+) or d is dextrorotatory. For a given chemical structure, these stereoisomers are identical except that they are mirror images of one another. A specific stereoisomer may also be referred to as an enantiomer, and a mixture of such isomers is often called an enantiomeric mixture. A 50:50 mixture of enantiomers is referred to as a racemic mixture or a racemate, which may occur where there has been no stereoselection or stereospecificity in a chemical reaction or process.

The terms "racemic mixture" and "racemate" refer to an equimolar mixture of two enantiomeric species, devoid of optical activity.

Note that, except as discussed below for tautomeric forms, specifically excluded from the term "isomers", as used herein, are structural (or constitutional) isomers (i.e. isomers which differ in the connections between atoms rather than merely by the position of atoms in space). For example, a reference to a methoxy group, —OCH$_3$, is not to be construed as a reference to its structural isomer, a hydroxymethyl group, —CH$_2$OH. Similarly, a reference to ortho-chlorophenyl is not to be construed as a reference to its structural isomer, meta-chlorophenyl. However, a reference to a class of structures may well include structurally isomeric forms falling within that class (e.g. $C_{1-7}$ alkyl includes n-propyl and iso-propyl; butyl includes n-, iso-, sec-, and tert-butyl; methoxyphenyl includes ortho-, meta-, and para-methoxyphenyl).

The above exclusion does not pertain to tautomeric forms, for example, keto-, enol-, and enolate-forms, as in, for example, the following tautomeric pairs: keto/enol (illustrated below), imine/enamine, amide/imino alcohol, amidine/amidine, nitroso/oxime, thioketone/enethiol, N-nitroso/hyroxyazo, and nitro/aci-nitro.

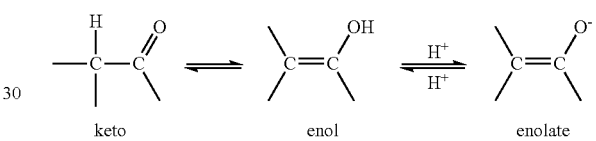

keto　　　enol　　　enolate

The term "tautomer" or "tautomeric form" refers to structural isomers of different energies which are interconvertible via a low energy barrier. For example, proton tautomers (also known as prototropic tautomers) include interconversions via migration of a proton, such as keto-enol and imine-enamine isomerizations. Valence tautomers include interconversions by reorganization of some of the bonding electrons.

Note that specifically included in the term "isomer" are compounds with one or more isotopic substitutions. For example, H may be in any isotopic form, including $^1$H, $^2$H (D), and $^3$H (T); C may be in any isotopic form, including $^{12}$C, $^{13}$C, and $^{14}$C; O may be in any isotopic form, including $^{16}$O and $^{18}$O; and the like.

Examples of isotopes that can be incorporated into compounds of the invention include isotopes of hydrogen, carbon, nitrogen, oxygen, phosphorous, fluorine, and chlorine, such as, but not limited to $^2$H (deuterium, D), $^3$H (tritium), $^{11}$C, $^{13}$C, $^{14}$C, $^{15}$N, $^{18}$F, $^{31}$P, $^{32}$P, $^{35}$S, $^{36}$Cl, and $^{125}$I. Various isotopically labeled compounds of the present invention, for example those into which radioactive isotopes such as 3H, 13C, and 14C are incorporated. Such isotopically labelled compounds may be useful in metabolic studies, reaction kinetic studies, detection or imaging techniques, such as positron emission tomography (PET) or single-photon emission computed tomography (SPECT) including drug or substrate tissue distribution assays, or in radioactive treatment of patients. Deuterium labelled or substituted therapeutic compounds of the invention may have improved DMPK (drug metabolism and pharmacokinetics) properties, relating to distribution, metabolism, and excretion (ADME). Substitution with heavier isotopes such as deuterium may afford certain therapeutic advantages resulting from greater metabolic stability, for example increased in vivo half-life or reduced dosage requirements. An 18F labeled compound may be useful for PET or SPECT studies. Isotopically labeled compounds of this invention and prodrugs thereof can generally be prepared by carrying out the procedures disclosed in the schemes or in the examples and preparations described below by substituting a readily available isotopically labeled reagent for a non-isotopically labeled reagent. Further, substitution with heavier isotopes, particularly deuterium (i.e., 2H or D) may afford certain therapeutic advantages resulting from greater metabolic stability, for example increased in vivo half-life or reduced dosage requirements or an improvement in therapeutic index. It is understood that deuterium in this context is regarded as a substituent. The concentration of such a heavier isotope, specifically deuterium, may be defined by an isotopic enrichment factor. In the compounds of this invention any atom not specifically designated as a particular isotope is meant to represent any stable isotope of that atom.

Unless otherwise specified, a reference to a particular compound includes all such isomeric forms, including (wholly or partially) racemic and other mixtures thereof. Methods for the preparation (e.g. asymmetric synthesis) and separation (e.g. fractional crystallisation and chromatographic means) of such isomeric forms are either known in the art or are readily obtained by adapting the methods taught herein, or known methods, in a known manner.

Biological Activity

In Vitro Cell Proliferation Assays

Generally, the cytotoxic or cytostatic activity of an antibody-drug conjugate (ADC) is measured by: exposing mammalian cells having receptor proteins, e.g. HER2, to the antibody of the ADC in a cell culture medium; culturing the cells for a period from about 6 hours to about 5 days; and measuring cell viability. Cell-based in vitro assays are used to measure viability (proliferation), cytotoxicity, and induction of apoptosis (caspase activation) of an ADC of the invention.

The in vitro potency of antibody-drug conjugates can be measured by a cell proliferation assay. The CellTiter-Glo® Luminescent Cell Viability Assay is a commercially available (Promega Corp., Madison, Wis.), homogeneous assay method based on the recombinant expression of Coleoptera luciferase (U.S. Pat. Nos. 5,583,024; 5,674,713 and 5,700,670). This cell proliferation assay determines the number of viable cells in culture based on quantitation of the ATP present, an indicator of metabolically active cells (Crouch et al (1993) *J. Immunol. Meth.* 160:81-88; U.S. Pat. No. 6,602,677). The CellTiter-Glo® Assay is conducted in 96 well format, making it amenable to automated high-throughput screening (HTS) (Cree et al (1995) *AntiCancer Drugs* 6:398-404). The homogeneous assay procedure involves adding the single reagent (CellTiter-Glo® Reagent) directly to cells cultured in serum-supplemented medium. Cell washing, removal of medium and multiple pipetting steps are not required. The system detects as few as 15 cells/well in a 384-well format in 10 minutes after adding reagent and mixing. The cells may be treated continuously with ADC, or they may be treated and separated from ADC. Generally, cells treated briefly, i.e. 3 hours, showed the same potency effects as continuously treated cells.

The homogeneous "add-mix-measure" format results in cell lysis and generation of a luminescent signal proportional to the amount of ATP present. The amount of ATP is directly proportional to the number of cells present in culture. The CellTiter-Glo® Assay generates a "glow-type" luminescent signal, produced by the luciferase reaction, which has a half-life generally greater than five hours, depending on cell type and medium used. Viable cells are reflected in relative luminescence units (RLU). The substrate, Beetle Luciferin, is oxidatively decarboxylated by recombinant firefly luciferase with concomitant conversion of ATP to AMP and generation of photons.

The in vitro potency of antibody-drug conjugates can also be measured by a cytotoxicity assay. Cultured adherent cells are washed with PBS, detached with trypsin, diluted in complete medium, containing 10% FCS, centrifuged, re-suspended in fresh medium and counted with a haemocytometer. Suspension cultures are counted directly. Monodisperse cell suspensions suitable for counting may require agitation of the suspension by repeated aspiration to break up cell clumps.

The cell suspension is diluted to the desired seeding density and dispensed (100 µl per well) into black 96 well plates. Plates of adherent cell lines are incubated overnight to allow adherence. Suspension cell cultures can be used on the day of seeding.

A stock solution (1 ml) of ADC (20 µg/ml) is made in the appropriate cell culture medium. Serial 10-fold dilutions of stock ADC are made in 15ml centrifuge tubes by serially transferring 100 µl to 900 µl of cell culture medium.

Four replicate wells of each ADC dilution (100 µl) are dispensed in 96-well black plates, previously plated with cell suspension (100 µl), resulting in a final volume of 200 µl. Control wells receive cell culture medium (100 µl).

If the doubling time of the cell line is greater than 30 hours, ADC incubation is for 5 days, otherwise a four day incubation is done.

At the end of the incubation period, cell viability is assessed with the Alamar blue assay. AlamarBlue (Invitrogen) is dispensed over the whole plate (20 µl per well) and incubated for 4 hours. Alamar blue fluorescence is measured at excitation 570 nm, emission 585 nm on the Varioskan flash plate reader. Percentage cell survival is calculated from the mean fluorescence in the ADC treated wells compared to the mean fluorescence in the control wells.

In Vivo Efficacy

The in vivo efficacy of antibody-drug conjugates (ADC) of the invention can be measured by tumor xenograft studies in mice. For example, the in vivo efficacy of an anti-HER2 ADC of the invention can be measured by a high expressing HER2 transgenic explant mouse model. An allograft is propagated from the Fo5 mmtv transgenic mouse which does not respond to, or responds poorly to, HERCEPTIN® therapy. Subjects are treated once with ADC at certain dose levels (mg/kg) and PBD drug exposure (µg/m$^2$); and placebo buffer control (Vehicle) and monitored over two weeks or more to measure the time to tumor doubling, log cell kill, and tumor shrinkage.

Use

The conjugates of the invention may be used to provide a PBD compound at a target location.

The target location is preferably a proliferative cell population. The antibody is an antibody for an antigen present on a proliferative cell population.

In one embodiment the antigen is absent or present at a reduced level in a non-proliferative cell population compared to the amount of antigen present in the proliferative cell population, for example a tumour cell population.

At the target location the linker may be cleaved so as to release a compound RelA or RelB. Thus, the conjugate may be used to selectively provide a compound RelA or RelB to the target location.

The linker may be cleaved by an enzyme present at the target location.

The target location may be in vitro, in vivo or ex vivo.

The antibody-drug conjugate (ADC) compounds of the invention include those with utility for anticancer activity. In particular, the compounds include an antibody conjugated, i.e. covalently attached by a linker, to a PBD drug moiety, i.e. toxin. When the drug is not conjugated to an antibody, the PBD drug has a cytotoxic effect. The biological activity of the PBD drug moiety is thus modulated by conjugation to an antibody. The antibody-drug conjugates (ADC) of the invention selectively deliver an effective dose of a cytotoxic agent to tumor tissue whereby greater selectivity, i.e. a lower efficacious dose, may be achieved.

Thus, in one aspect, the present invention provides a conjugate compound as described herein for use in therapy.

In a further aspect there is also provides a conjugate compound as described herein for use in the treatment of a proliferative disease. A second aspect of the present invention provides the use of a conjugate compound in the manufacture of a medicament for treating a proliferative disease.

One of ordinary skill in the art is readily able to determine whether or not a candidate conjugate treats a proliferative condition for any particular cell type. For example, assays which may conveniently be used to assess the activity offered by a particular compound are described in the examples below.

The term "proliferative disease" pertains to an unwanted or uncontrolled cellular proliferation of excessive or abnormal cells which is undesired, such as, neoplastic or hyperplastic growth, whether in vitro or in vivo.

Examples of proliferative conditions include, but are not limited to, benign, pre-malignant, and malignant cellular proliferation, including but not limited to, neoplasms and tumours (e.g. histocytoma, glioma, astrocyoma, osteoma), cancers (e.g. lung cancer, small cell lung cancer, gastrointestinal cancer, bowel cancer, colon cancer, breast carinoma, ovarian carcinoma, prostate cancer, testicular cancer, liver cancer, kidney cancer, bladder cancer, pancreas cancer, brain cancer, sarcoma, osteosarcoma, Kaposi's sarcoma, melanoma), lymphomas, leukemias, psoriasis, bone diseases, fibroproliferative disorders (e.g. of connective tissues), and atherosclerosis. Cancers of particular interest include, but are not limited to, leukemias and ovarian cancers.

Any type of cell may be treated, including but not limited to, lung, gastrointestinal (including, e.g. bowel, colon), breast (mammary), ovarian, prostate, liver (hepatic), kidney (renal), bladder, pancreas, brain, and skin.

In one embodiment, the treatment is of a pancreatic cancer. In one embodiment, the treatment is of a tumour having $\alpha_v\beta_6$ integrin on the surface of the cell.

It is contemplated that the antibody-drug conjugates (ADC) of the present invention may be used to treat various diseases or disorders, e.g. characterized by the overexpression of a tumor antigen. Exemplary conditions or hyperproliferative disorders include benign or malignant tumors; leukemia, haematological, and lymphoid malignancies. Others include neuronal, glial, astrocytal, hypothalamic, glandular, macrophagal, epithelial, stromal, blastocoelic, inflammatory, angiogenic and immunologic, including autoimmune, disorders.

Generally, the disease or disorder to be treated is a hyperproliferative disease such as cancer. Examples of cancer to be treated herein include, but are not limited to, carcinoma, lymphoma, blastoma, sarcoma, and leukemia or lymphoid malignancies. More particular examples of such cancers include squamous cell cancer (e.g. epithelial squamous cell cancer), lung cancer including small-cell lung cancer, non-small cell lung cancer, adenocarcinoma of the lung and squamous carcinoma of the lung, cancer of the peritoneum, hepatocellular cancer, gastric or stomach cancer including gastrointestinal cancer, pancreatic cancer, glioblastoma, cervical cancer, ovarian cancer, liver cancer, bladder cancer, hepatoma, breast cancer, colon cancer, rectal cancer, colorectal cancer, endometrial or uterine carcinoma, salivary gland carcinoma, kidney or renal cancer, prostate cancer, vulval cancer, thyroid cancer, hepatic carcinoma, anal carcinoma, penile carcinoma, as well as head and neck cancer.

Autoimmune diseases for which the ADC compounds may be used in treatment include rheumatologic disorders (such as, for example, rheumatoid arthritis, Sjögren's syndrome, scleroderma, lupus such as SLE and lupus nephritis, polymyositis/dermatomyositis, cryoglobulinemia, antiphospholipid antibody syndrome, and psoriatic arthritis), osteoarthritis, autoimmune gastrointestinal and liver disorders (such as, for example, inflammatory bowel diseases (e.g. ulcerative colitis and Crohn's disease), autoimmune gastritis and pernicious anemia, autoimmune hepatitis, primary biliary cirrhosis, primary sclerosing cholangitis, and celiac disease), vasculitis (such as, for example, ANCA-associated vasculitis, including Churg-Strauss vasculitis, Wegener's granulomatosis, and polyarteriitis), autoimmune neurological disorders (such as, for example, multiple sclerosis, opsoclonus myoclonus syndrome, myasthenia gravis, neuromyelitis optica, Parkinson's disease, Alzheimer's disease, and autoimmune polyneuropathies), renal disorders (such as, for example, glomerulonephritis, Goodpasture's syndrome, and Berger's disease), autoimmune dermatologic disorders (such as, for example, psoriasis, urticaria, hives, pemphigus vulgaris, bullous pemphigoid, and cutaneous lupus erythematosus), hematologic disorders (such as, for example, thrombocytopenic purpura, thrombotic thrombocytopenic purpura, post-transfusion purpura, and autoimmune hemolytic anemia), atherosclerosis, uveitis, autoimmune hearing diseases (such as, for example, inner ear disease and hearing loss), Behcet's disease, Raynaud's syndrome, organ transplant, and autoimmune endocrine disorders (such as, for example, diabetic-related autoimmune diseases such as insulin-dependent diabetes mellitus (IDDM), Addison's disease, and autoimmune thyroid disease (e.g. Graves' disease and thyroiditis)). More preferred such diseases include, for example, rheumatoid arthritis, ulcerative colitis, ANCA-associated vasculitis, lupus, multiple sclerosis, Sjögren's syndrome, Graves' disease, IDDM, pernicious anemia, thyroiditis, and glomerulonephritis.

Methods of Treatment

The conjugates of the present invention may be used in a method of therapy. Also provided is a method of treatment, comprising administering to a subject in need of treatment a therapeutically-effective amount of a conjugate compound of the invention. The term "therapeutically effective amount" is an amount sufficient to show benefit to a patient. Such benefit may be at least amelioration of at least one symptom. The actual amount administered, and rate and time-course of administration, will depend on the nature and severity of what is being treated. Prescription of treatment, e.g. decisions on dosage, is within the responsibility of general practitioners and other medical doctors.

A compound of the invention may be administered alone or in combination with other treatments, either simultaneously or sequentially dependent upon the condition to be treated. Examples of treatments and therapies include, but are not limited to, chemotherapy (the administration of active agents, including, e.g. drugs, such as chemotherapeutics); surgery; and radiation therapy.

A "chemotherapeutic agent" is a chemical compound useful in the treatment of cancer, regardless of mechanism of action. Classes of chemotherapeutic agents include, but are not limited to: alkylating agents, antimetabolites, spindle poison plant alkaloids, cytotoxic/antitumor antibiotics, topoisomerase inhibitors, antibodies, photosensitizers, and kinase inhibitors. Chemotherapeutic agents include compounds used in "targeted therapy" and conventional chemotherapy.

Examples of chemotherapeutic agents include: erlotinib (TARCEVA®, Genentech/OSI Pharm.), docetaxel (TAXOTERE®, Sanofi-Aventis), 5-FU (fluorouracil, 5-fluorouracil, CAS No. 51-21-8), gemcitabine (GEMZAR®, Lilly), PD-0325901 (CAS No. 391210-10-9, Pfizer), cisplatin (cis-diamine, dichloroplatinum(II), CAS No. 15663-27-1), carboplatin (CAS No. 41575-94-4), paclitaxel (TAXOL®, Bristol-Myers Squibb Oncology, Princeton, N.J.), trastuzumab (HERCEPTIN®, Genentech), temozolomide(4-methyl-5-oxo-2,3,4,6,8-pentazabicyclo[4.3.0]nona-2,7,9-triene-9-carboxamide, CAS No. 85622-93-1, TEMODAR®, TEMODAL®, Schering Plough), tamoxifen((Z)-2-[4-(1,2-diphenylbut-1-enyl)phenoxy]-N,N-dimethylethanamine, NOLVADEX®, ISTUBAL®, VALODEX®), and doxorubicin (ADRIAMYCIN®), Akti-1/2, HPPD, and rapamycin. More examples of chemotherapeutic agents include: oxaliplatin (ELOXATIN®, Sanofi), bortezomib (VELCADE®, Millennium Pharm.), sutent (SUNITINIB®, SU11248, Pfizer), letrozole (FEMARA®, Novartis), imatinib mesylate (GLEEVEC®, Novartis), XL-518 (Mek inhibitor, Exelixis, WO 2007/044515), ARRY-886 (Mek inhibitor, AZD6244, Array BioPharma, Astra Zeneca), SF-1126 (P13K inhibitor, Semafore Pharmaceuticals), BEZ-235 (P13K inhibitor, Novartis), XL-147 (P13K inhibitor, Exelixis), PTK787/ZK 222584 (Novartis), fulvestrant (FASLODEX®, AstraZeneca), leucovorin (folinic acid), rapamycin (sirolimus, RAPAMUNE®, Wyeth), lapatinib (TYKERB®, GSK572016, Glaxo Smith Kline), lonafarnib (SARASAR™, SCH 66336, Schering Plough), sorafenib (NEXAVAR®, BAY43-9006, Bayer Labs), gefitinib (IRESSA®, AstraZeneca), irinotecan (CAMPTOSAR®, CPT-11, Pfizer), tipifarnib (ZARNESTRA™, Johnson & Johnson), ABRAXANE™ (Cremophor-free), albumin-engineered nanoparticle formulations of paclitaxel (American Pharmaceutical Partners, Schaumberg, Ill.), vandetanib (rINN, ZD6474, ZACTIMA®, AstraZeneca), chloranmbucil, AG1478, AG1571 (SU 5271; Sugen), temsirolimus (TORISEL®, Wyeth), pazopanib (GlaxoSmithKline), canfosfamide (TELCYTA®, Telik), thiotepa and cyclosphosphamide (CYTOXAN®, NEOSAR®); alkyl sulfonates such as busulfan, improsulfan and piposulfan; aziridines such as benzodopa, carboquone, meturedopa, and uredopa; ethyleniminnes and methylamelamines including altretamine, triethylenemelamine, triethylenephosphoramide, triethylenethiophosphoramide and trimethylomelamine; acetogenins (especially bullatacin and bullatacinone); a camptothecin (including the synthetic analog topotecan); bryostatin; callystatin; CC-1065 (including its adozelesin, carzelesin and bizelesin synthetic analogs); cryptophycins (particularly cryptophycin 1 and cryptophycin 8); dolastatin; duocarmycin (including the synthetic analogs, KW-2189 and CB1-TM1); eleutherobin; pancratistatin; a sarcodictyin; spongistatin; nitrogen mustards such as chlorambucil, chlornaphazine, chlorophosphamide, estramustine, ifosfamide, mechlorethamine, mechlorethamine oxide hydrochloride, melphalan, novembichin, phenesterine, prednimustine, trofosfamide, uracil mustard; nitrosoureas such as carmustine, chlorozotocin, fotemustine, lomustine, nimustine, and ranimnustine; antibiotics such as the enediyne antibiotics (e.g. calicheamicin, calicheamicin gamma1I, calicheamicin omegaI1 (Angew Chem. Intl. Ed. Engl. (1994) 33:183-186); dynemicin, dynemicin A; bisphosphonates, such as clodronate; an esperamicin; as well as neocarzinostatin chromophore and related chromoprotein enediyne antibiotic chromophores), aclacinomysins, actinomycin, authramycin, azaserine, bleomycins, cactinomycin, carabicin, carminomycin, carzinophilin, chromomycinis, dactinomycin, daunorubicin, detorubicin, 6-diazo-5-oxo-L-norleucine, morpholino-doxorubicin, cyanomorpholino-doxorubicin, 2-pyrrolino-doxorubicin and deoxydoxorubicin), epirubicin, esorubicin, idarubicin, nemorubicin, marcellomycin, mitomycins such as mitomycin C, mycophenolic acid, nogalamycin, olivomycins, peplomycin, porfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogs such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; defofamine; demecolcine; diaziquone; elfornithine; elliptinium acetate; an epothilone; etoglucid; gallium nitrate; hydroxyurea; lentinan; lonidainine; maytansinoids such as maytansine and ansamitocins; mitoguazone; mitoxantrone; mopidanmol; nitraerine; pentostatin; phenamet; pirarubicin; losoxantrone; podophyllinic acid; 2-ethylhydrazide; procarbazine; PSK® polysaccharide complex (JHS Natural Products, Eugene, Oreg.); razoxane; rhizoxin; sizofiran; spirogermanium; tenuazonic acid; triaziquone; 2,2',2"-trichlorotriethylamine; trichothecenes (especially T-2 toxin, verracurin A, roridin A and anguidine); urethan; vindesine; dacarbazine; mannomustine; mitobronitol; mitolactol; pipobroman; gacytosine; arabinoside ("Ara-C"); cyclophosphamide; thiotepa; 6-thioguanine; mercaptopurine; methotrexate; platinum analogs such as cisplatin and carboplatin; vinblastine; etoposide (VP-16); ifosfamide; mitoxantrone; vincristine; vinorelbine (NAVELBINE®); novantrone; teniposide; edatrexate; daunomycin; aminopterin; capecitabine (XELODA®, Roche); ibandronate; CPT-11; topoisomerase inhibitor RFS 2000; difluoromethylornithine (DMFO); retinoids such as retinoic acid; and pharmaceutically acceptable salts, acids and derivatives of any of the above.

Also included in the definition of "chemotherapeutic agent" are: (i) anti-hormonal agents that act to regulate or inhibit hormone action on tumors such as anti-estrogens and selective estrogen receptor modulators (SERMs), including, for example, tamoxifen (including NOLVADEX®; tamoxifen citrate), raloxifene, droloxifene, 4-hydroxytamoxifen, trioxifene, keoxifene, LY117018, onapristone, and FARESTON® (toremifine citrate); (ii) aromatase inhibitors that inhibit the enzyme aromatase, which regulates estrogen production in the adrenal glands, such as, for example, 4(5)-imidazoles, aminoglutethimide, MEGASE® (megestrol acetate), AROMASIN® (exemestane; Pfizer), formestanie, fadrozole, RIVISOR® (vorozole), FEMARA® (letrozole; Novartis), and ARIMIDEX® (anastrozole;

AstraZeneca); (iii) anti-androgens such as flutamide, nilutamide, bicalutamide, leuprolide, and goserelin; as well as troxacitabine (a 1,3-dioxolane nucleoside cytosine analog); (iv) protein kinase inhibitors such as MEK inhibitors (WO 2007/044515); (v) lipid kinase inhibitors; (vi) antisense oligonucleotides, particularly those which inhibit expression of genes in signaling pathways implicated in aberrant cell proliferation, for example, PKC-alpha, Raf and H-Ras, such as oblimersen (GENASENSE®, Genta Inc.); (vii) ribozymes such as VEGF expression inhibitors (e.g., ANGIOZYME®) and HER2 expression inhibitors; (viii) vaccines such as gene therapy vaccines, for example, ALLOVECTIN®, LEUVECTIN®, and VAXID®; PROLEUKIN® rIL-2; topoisomerase 1 inhibitors such as LURTOTECAN®; ABARELIX® rmRH; (ix) anti-angiogenic agents such as bevacizumab (AVASTIN®, Genentech); and pharmaceutically acceptable salts, acids and derivatives of any of the above.

Also included in the definition of "chemotherapeutic agent" are therapeutic antibodies such as alemtuzumab (Campath), bevacizumab (AVASTIN®, Genentech); cetuximab (ERBITUX®, Imclone); panitumumab (VECTIBIX®, Amgen), rituximab (RITUXAN®, Genentech/Biogen Idec), ofatumumab (ARZERRA®, GSK), pertuzumab (PERJETA™, OMNITARG™, 2C4, Genentech), trastuzumab (HERCEPTIN®, Genentech), tositumomab (Bexxar, Corixia), and the antibody drug conjugate, gemtuzumab ozogamicin (MYLOTARG®, Wyeth).

Humanized monoclonal antibodies with therapeutic potential as chemotherapeutic agents in combination with the conjugates of the invention include: alemtuzumab, apolizumab, aselizumab, atlizumab, bapineuzumab, bevacizumab, bivatuzumab mertansine, cantuzumab mertansine, cedelizumab, certolizumab pegol, cidfusituzumab, cidtuzumab, daclizumab, eculizumab, efalizumab, epratuzumab, erlizumab, felvizumab, fontolizumab, gemtuzumab ozogamicin, inotuzumab ozogamicin, ipilimumab, labetuzumab, lintuzumab, matuzumab, mepolizumab, motavizumab, motovizumab, natalizumab, nimotuzumab, nolovizumab, numavizumab, ocrelizumab, omalizumab, palivizumab, pascolizumab, pecfusituzumab, pectuzumab, pertuzumab, pexelizumab, ralivizumab, ranibizumab, reslivizumab, reslizumab, resyvizumab, rovelizumab, ruplizumab, sibrotuzumab, siplizumab, sontuzumab, tacatuzumab tetraxetan, tadocizumab, talizumab, tefibazumab, tocilizumab, toralizumab, trastuzumab, tucotuzumab celmoleukin, tucusituzumab, umavizumab, urtoxazumab, and visilizumab.

Pharmaceutical compositions according to the present invention, and for use in accordance with the present invention, may comprise, in addition to the active ingredient, i.e. a conjugate compound, a pharmaceutically acceptable excipient, carrier, buffer, stabiliser or other materials well known to those skilled in the art. Such materials should be non-toxic and should not interfere with the efficacy of the active ingredient. The precise nature of the carrier or other material will depend on the route of administration, which may be oral, or by injection, e.g. cutaneous, subcutaneous, or intravenous.

Pharmaceutical compositions for oral administration may be in tablet, capsule, powder or liquid form. A tablet may comprise a solid carrier or an adjuvant. Liquid pharmaceutical compositions generally comprise a liquid carrier such as water, petroleum, animal or vegetable oils, mineral oil or synthetic oil. Physiological saline solution, dextrose or other saccharide solution or glycols such as ethylene glycol, propylene glycol or polyethylene glycol may be included. A capsule may comprise a solid carrier such a gelatin.

For intravenous, cutaneous or subcutaneous injection, or injection at the site of affliction, the active ingredient will be in the form of a parenterally acceptable aqueous solution which is pyrogen-free and has suitable pH, isotonicity and stability. Those of relevant skill in the art are well able to prepare suitable solutions using, for example, isotonic vehicles such as Sodium Chloride Injection, Ringer's Injection, Lactated Ringer's Injection. Preservatives, stabilisers, buffers, antioxidants and/or other additives may be included, as required.

Formulations

While it is possible for the conjugate compound to be used (e.g., administered) alone, it is often preferable to present it as a composition or formulation.

In one embodiment, the composition is a pharmaceutical composition (e.g., formulation, preparation, medicament) comprising a conjugate compound, as described herein, and a pharmaceutically acceptable carrier, diluent, or excipient.

In one embodiment, the composition is a pharmaceutical composition comprising at least one conjugate compound, as described herein, together with one or more other pharmaceutically acceptable ingredients well known to those skilled in the art, including, but not limited to, pharmaceutically acceptable carriers, diluents, excipients, adjuvants, fillers, buffers, preservatives, anti-oxidants, lubricants, stabilisers, solubilisers, surfactants (e.g., wetting agents), masking agents, colouring agents, flavouring agents, and sweetening agents.

In one embodiment, the composition further comprises other active agents, for example, other therapeutic or prophylactic agents.

Suitable carriers, diluents, excipients, etc. can be found in standard pharmaceutical texts. See, for example, *Handbook of Pharmaceutical Additives,* 2nd Edition (eds. M. Ash and I. Ash), 2001 (Synapse Information Resources, Inc., Endicott, New York, USA), *Remington's Pharmaceutical Sciences,* 20th edition, pub. Lippincott, Williams & Wilkins, 2000; and *Handbook of Pharmaceutical Excipients,* 2nd edition, 1994.

Another aspect of the present invention pertains to methods of making a pharmaceutical composition comprising admixing at least one [$^{11}$C]-radiolabelled conjugate or conjugate-like compound, as defined herein, together with one or more other pharmaceutically acceptable ingredients well known to those skilled in the art, e.g., carriers, diluents, excipients, etc. If formulated as discrete units (e.g., tablets, etc.), each unit contains a predetermined amount (dosage) of the active compound.

The term "pharmaceutically acceptable," as used herein, pertains to compounds, ingredients, materials, compositions, dosage forms, etc., which are, within the scope of sound medical judgment, suitable for use in contact with the tissues of the subject in question (e.g., human) without excessive toxicity, irritation, allergic response, or other problem or complication, commensurate with a reasonable benefit/risk ratio. Each carrier, diluent, excipient, etc. must also be "acceptable" in the sense of being compatible with the other ingredients of the formulation.

The formulations may be prepared by any methods well known in the art of pharmacy. Such methods include the step of bringing into association the active compound with a carrier which constitutes one or more accessory ingredients. In general, the formulations are prepared by uniformly and intimately bringing into association the active compound with carriers (e.g., liquid carriers, finely divided solid carrier, etc.), and then shaping the product, if necessary.

The formulation may be prepared to provide for rapid or slow release; immediate, delayed, timed, or sustained release; or a combination thereof.

Formulations suitable for parenteral administration (e.g., by injection), include aqueous or non-aqueous, isotonic, pyrogen-free, sterile liquids (e.g., solutions, suspensions), in which the active ingredient is dissolved, suspended, or otherwise provided (e.g., in a liposome or other microparticulate). Such liquids may additional contain other pharmaceutically acceptable ingredients, such as anti-oxidants, buffers, preservatives, stabilisers, bacteriostats, suspending agents, thickening agents, and solutes which render the formulation isotonic with the blood (or other relevant bodily fluid) of the intended recipient. Examples of excipients include, for example, water, alcohols, polyols, glycerol, vegetable oils, and the like. Examples of suitable isotonic carriers for use in such formulations include Sodium Chloride Injection, Ringer's Solution, or Lactated Ringer's Injection. Typically, the concentration of the active ingredient in the liquid is from about 1 ng/ml to about 10 µg/ml, for example from about 10 ng/ml to about 1 µg/ml. The formulations may be presented in unit-dose or multi-dose sealed containers, for example, ampoules and vials, and may be stored in a freeze-dried (lyophilised) condition requiring only the addition of the sterile liquid carrier, for example water for injections, immediately prior to use. Extemporaneous injection solutions and suspensions may be prepared from sterile powders, granules, and tablets.

Dosage

It will be appreciated by one of skill in the art that appropriate dosages of the conjugate compound, and compositions comprising the conjugate compound, can vary from patient to patient. Determining the optimal dosage will generally involve the balancing of the level of therapeutic benefit against any risk or deleterious side effects. The selected dosage level will depend on a variety of factors including, but not limited to, the activity of the particular compound, the route of administration, the time of administration, the rate of excretion of the compound, the duration of the treatment, other drugs, compounds, and/or materials used in combination, the severity of the condition, and the species, sex, age, weight, condition, general health, and prior medical history of the patient. The amount of compound and route of administration will ultimately be at the discretion of the physician, veterinarian, or clinician, although generally the dosage will be selected to achieve local concentrations at the site of action which achieve the desired effect without causing substantial harmful or deleterious side-effects.

Administration can be effected in one dose, continuously or intermittently (e.g., in divided doses at appropriate intervals) throughout the course of treatment. Methods of determining the most effective means and dosage of administration are well known to those of skill in the art and will vary with the formulation used for therapy, the purpose of the therapy, the target cell(s) being treated, and the subject being treated. Single or multiple administrations can be carried out with the dose level and pattern being selected by the treating physician, veterinarian, or clinician.

In general, a suitable dose of the active compound is in the range of about 100 ng to about 25 mg (more typically about 1 µg to about 10 mg) per kilogram body weight of the subject per day. Where the active compound is a salt, an ester, an amide, a prodrug, or the like, the amount administered is calculated on the basis of the parent compound and so the actual weight to be used is increased proportionately.

In one embodiment, the active compound is administered to a human patient according to the following dosage regime: about 100 mg, 3 times daily.

In one embodiment, the active compound is administered to a human patient according to the following dosage regime: about 150 mg, 2 times daily.

In one embodiment, the active compound is administered to a human patient according to the following dosage regime: about 200 mg, 2 times daily.

However in one embodiment, the conjugate compound is administered to a human patient according to the following dosage regime: about 50 or about 75 mg, 3 or 4 times daily.

In one embodiment, the conjugate compound is administered to a human patient according to the following dosage regime: about 100 or about 125 mg, 2 times daily.

The dosage amounts described above may apply to the conjugate (including the PBD moiety and the linker to the antibody) or to the effective amount of PBD compound provided, for example the amount of compound that is releasable after cleavage of the linker.

For the prevention or treatment of disease, the appropriate dosage of an ADC of the invention will depend on the type of disease to be treated, as defined above, the severity and course of the disease, whether the molecule is administered for preventive or therapeutic purposes, previous therapy, the patient's clinical history and response to the antibody, and the discretion of the attending physician. The molecule is suitably administered to the patient at one time or over a series of treatments. Depending on the type and severity of the disease, about 1 µg/kg to 15 mg/kg (e.g. 0.1-20 mg/kg) of molecule is an initial candidate dosage for administration to the patient, whether, for example, by one or more separate administrations, or by continuous infusion. A typical daily dosage might range from about 1 µg/kg to 100 mg/kg or more, depending on the factors mentioned above. An exemplary dosage of ADC to be administered to a patient is in the range of about 0.1 to about 10 mg/kg of patient weight. For repeated administrations over several days or longer, depending on the condition, the treatment is sustained until a desired suppression of disease symptoms occurs. An exemplary dosing regimen comprises a course of administering an initial loading dose of about 4 mg/kg, followed by additional doses every week, two weeks, or three weeks of an ADC. Other dosage regimens may be useful. The progress of this therapy is easily monitored by conventional techniques and assays.

Treatment

The term "treatment," as used herein in the context of treating a condition, pertains generally to treatment and therapy, whether of a human or an animal (e.g., in veterinary applications), in which some desired therapeutic effect is achieved, for example, the inhibition of the progress of the condition, and includes a reduction in the rate of progress, a halt in the rate of progress, regression of the condition, amelioration of the condition, and cure of the condition. Treatment as a prophylactic measure (i.e., prophylaxis, prevention) is also included.

The term "therapeutically-effective amount," as used herein, pertains to that amount of an active compound, or a material, composition or dosage from comprising an active compound, which is effective for producing some desired therapeutic effect, commensurate with a reasonable benefit/risk ratio, when administered in accordance with a desired treatment regimen.

Similarly, the term "prophylactically-effective amount," as used herein, pertains to that amount of an active compound, or a material, composition or dosage from comprising an active compound, which is effective for producing some desired prophylactic effect, commensurate with a reasonable benefit/risk ratio, when administered in accordance with a desired treatment regimen.

Preparation of Drug Conjugates

Antibody drug conjugates, as well as conjugates with other cell binding agents, may be prepared by several routes, employing organic chemistry reactions, conditions, and reagents known to those skilled in the art, including reaction of a nucleophilic group of an antibody or cell binding agent with a drug-linker reagent. This method may be employed with a variety of antibodies and cell binding agents to prepare the antibody-drug conjugates of the invention.

Nucleophilic groups on antibodies include, but are not limited to side chain thiol groups, e.g. cysteine. Thiol groups are nucleophilic and capable of reacting to form covalent bonds with electrophilic groups on linker moieties such as those of the present invention. Certain antibodies have reducible interchain disulfides, i.e. cysteine bridges. Antibodies may be made reactive for conjugation with linker reagents by treatment with a reducing agent such as DTT (Cleland's reagent, dithiothreitol) or TCEP (tris(2-carboxyethyl)phosphine hydrochloride; Getz et al (1999) Anal. Biochem. Vol 273:73-80; Soltec Ventures, Beverly, Mass.). Each cysteine disulfide bridge will thus form, theoretically, two reactive thiol nucleophiles. Additional nucleophilic groups can be introduced into antibodies through the reaction of lysines with 2-iminothiolane (Traut's reagent) resulting in conversion of an amine into a thiol.

The Subject/Patient

The subject/patient may be an animal, mammal, a placental mammal, a marsupial (e.g., kangaroo, wombat), a monotreme (e.g., duckbilled platypus), a rodent (e.g., a guinea pig, a hamster, a rat, a mouse), murine (e.g., a mouse), a lagomorph (e.g., a rabbit), avian (e.g., a bird), canine (e.g., a dog), feline (e.g., a cat), equine (e.g., a horse), porcine (e.g., a pig), ovine (e.g., a sheep), bovine (e.g., a cow), a primate, simian (e.g., a monkey or ape), a monkey (e.g., marmoset, baboon), an ape (e.g., gorilla, chimpanzee, orangutang, gibbon), or a human.

Furthermore, the subject/patient may be any of its forms of development, for example, a foetus. In one preferred embodiment, the subject/patient is a human.

In one embodiment, the patient is a population where each patient has a tumour having $\alpha_v\beta_6$ integrin on the surface of the cell.

EXAMPLES

General Experimental Methods

Reaction progress was monitored by thin-layer chromatography (TLC) using Merck Kieselgel 60 F254 silica gel, with fluorescent indicator on aluminium plates. Visualisation of TLC was achieved with UV light or iodine vapour unless otherwise stated. Flash chromatography was performed using Merck Kieselgel 60 F254 silica gel. Extraction and chromatography solvents were bought and used without further purification from Fisher Scientific, U.K. All chemicals were purchased from Aldrich, Lancaster or BDH.

$^1$H and $^{13}$C NMR spectra were obtained on a Bruker Avance 400 spectrometer. Coupling constants are quoted in hertz (Hz). Chemical shifts are recorded in parts per million (ppm) downfield from tetramethylsilane. Spin multiplicities are described as s (singlet), bs (broad singlet), d (doublet), t (triplet), q (quartet), p (pentuplet) and m (multiplet). IR spectra were recorded on a Perkin-Elmer FT/IR paragon 1000 spectrophotometer by application of the sample in a solution of chloroform using the ATR "golden gate" system. Optical rotations were measured at ambient temperature using a Bellingham and Stanley ADP 220 polarimeter. Mass spectrometry was performed on a ThermoQuest Navigator from Thermo Electron, Electrospray (ES) spectra were obtained at 20 to 30 V. Accurate mass measurements were performed using Micromass Q-TOF global tandem. All samples were run under electrospray ionization mode using 50% acetonitrile in water and 0.1% formic acid as a solvent. Samples were run on W mode which gives a typical resolution of 19000 at FWHH. The instrument was calibrated with [Glu]-Fibrinopeptide B immediately prior to measurement.

LCMS

LC/MS (Shimazu LCMS-2020) using a mobile phase of water (A) (formic acid 0.1%) and acetonitrile (B) (formic acid 0.1%).

Gradient: initial composition 5% B held over 0.25 min, then increase from 5% B to 100% B over a 2 min period. The composition was held for 0.50 min at 100% B, then returned to 5% B in 0.05 minutes and hold there for 0.05 min. Total gradient run time equals 3 min. Flow rate 0.8 mL/min. Wavelength detection range: 190 to 800 nm. Oven temperature: 50° C. Column: Waters Acquity UPLC BEH Shield RP18 1.7 μm 2.1×50 mm.

Preparative HPLC

The conditions for the preparative HPLC were as follow: the HPLC (Shimadzu UFLC) was run using a mobile phase of water (0.1% formic acid) A and acetonitrile (0.1% formic acid) B.

Wavelength detection range: 254 nm.

Column: Phenomenex Gemini 5μ C18 150×21-20 mm.

Gradient:

| | B |
|---|---|
| t = 0 | 13% |
| t = 15.00 | 95% |
| t = 17.00 | 95% |
| t = 17.10 | 13% |
| t = 20.00 | 13% |

Total gradient run time is 20 min; flow rate 20.00 mL/min.

Synthesis of Intermediate 12

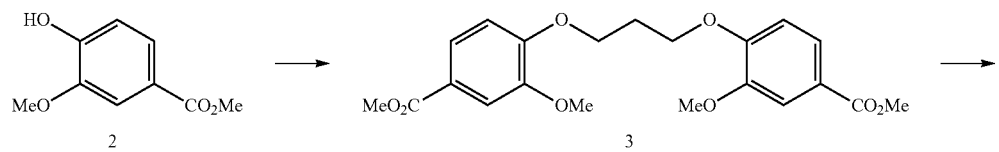

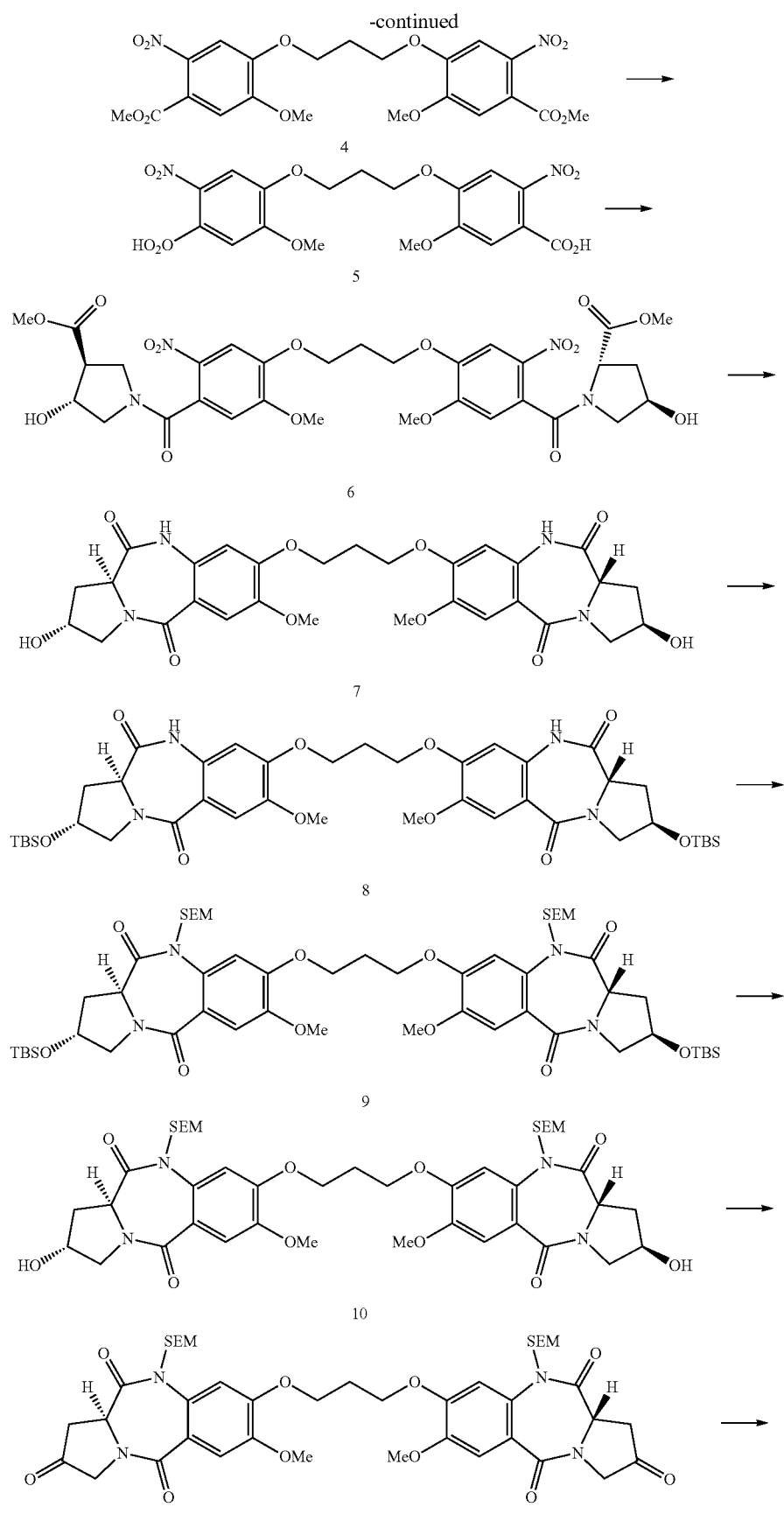

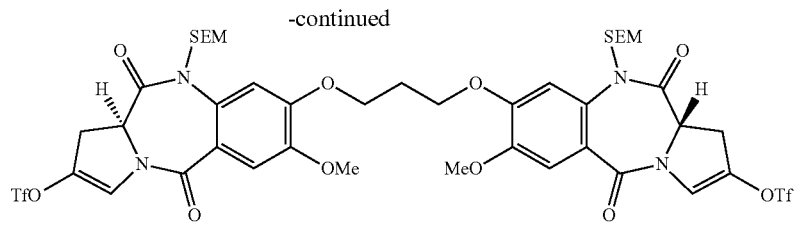

12

(a) 1',3'-Bis[2-methoxy-4-(methoxycarbonyl)phenoxy]propane (3)

Diisopropyl azodicarboxylate (71.3 mL, 73.2 g, 362 mmol) was added drop-wise over a period of 60 min to an overhead stirred solution of methyl vanillate 2 (60.0 g, 329 mmol) and Ph$_3$P (129.4 g, 494 mmol) in anhydrous THF (800 mL) at 0-5° C. (ice/acetone) under a nitrogen atmosphere. The reaction mixture was allowed to stir at 0-5° C. for an additional 1 hour after which time a solution of 1,3-propanediol (11.4 mL, 12.0 g, 158 mmol) in THF (12 mL) was added drop-wise over a period of 20 min. The reaction mixture was allowed to warm to room temperature and stirred for 5 days. The resulting white precipitate 3 was collected by vacuum filtration, washed with THF and dried in a vacuum desiccator to constant weight. Yield=54.7 g (84% based on 1,3-propanediol). Purity satisfactory by LC/MS (3.20 min (ES+) m/z (relative intensity) 427 ([M+Na]$^+$10); $^1$H NMR (400 MHz, CDCl$_3$) δ 7.64 (dd, 2H, J=1.8, 8.3 Hz), 7.54 (d, 2H, J=1.8 Hz), 6.93 (d, 2H, J=8.5 Hz), 4.30 (t, 4H, J=6.1 Hz), 3.90 (s, 6H), 3.89 (s, 6H), 2.40 (p, 2H, J=6.0 Hz).

(b) 1',3'-Bis[2-methoxy-4-(methoxycarbonyl)-5-nitrophenoxy]propane (4)

Solid Cu(NO$_3$)$_2$.3H$_2$O (81.5 g, 337.5 mmol) was added slowly to an overhead stirred slurry of the bis-ester 3 (54.7 g, 135 mmol) in acetic anhydride (650 mL) at 0-5° C. (ice/acetone). The reaction mixture was allowed to stir for 1 hour at 0-5° C. and then allowed to warm to room temperature. A mild exotherm (ca. 40-50° C.), accompanied by thickening of the mixture and evolution of NO$_2$ was observed at this stage. Additional acetic anhydride (300 mL) was added and the reaction mixture was allowed to stir for 16 hours at room temperature. The reaction mixture was poured on to ice (~1.5 L), stirred and allowed to return to room temperature. The resulting yellow precipitate was collected by vacuum filtration and dried in a desiccator to afford the desired bis-nitro compound 4 as a yellow solid. Yield=66.7 g (100%). Purity satisfactory by LC/MS (3.25 min (ES+) m/z (relative intensity) 517 ([M+Na]$^+$, 40); $^1$H NMR (400 MHz, CDCl$_3$) δ 7.49 (s, 2H), 7.06 (s, 2H), 4.32 (t, 4H, J=6.0 Hz), 3.95 (s, 6H), 3.90 (s, 6H), 2.45-2.40 (m, 2H).

(c) 1',3'-Bis(4-carboxy-2-methoxy-5-nitrophenoxy)propane (5)

A slurry of the methyl ester 4 (66.7 g, 135 mmol) in THF (700 mL) was treated with 1N NaOH (700 mL) and the reaction mixture was allowed to stir vigorously at room temperature. After 4 days stirring, the slurry became a dark coloured solution which was subjected to rotary evaporation under reduced pressure to remove THF. The resulting aqueous residue was acidified to pH 1 with concentrated HCl and the colourless precipitate 5 was collected and dried thoroughly in a vacuum oven (50° C.). Yield=54.5 g (87%). Purity satisfactory by LC/MS (2.65 min (ES+) m/z (relative intensity) 489 ([M+Na]$^+$, 30)); $^1$H NMR (400 MHz, DMSO-d$_6$) δ 7.62 (s, 2H), 7.30 (s, 2H), 4.29 (t, 4H, J=6.0 Hz), 3.85 (s, 6H), 2.30-2.26 (m, 2H).

(d) 1,1'-[[(Propane-1,3-diyl)dioxy]bis[(5-methoxy-2-nitro-1,4-phenylene)carbonyl]]bis[(2S,4R)-methyl-4-hydroxypyrrolidine-2-carboxylate] (6)

Oxalyl chloride (24.5 mL, 35.6 g, 281 mmol) was added to a stirred suspension of the nitrobenzoic acid 5 (43 g, 92.3 mmol) and DMF (6 mL) in anhydrous DCM (600 mL). Following initial effervescence the reaction suspension became a solution and the mixture was allowed to stir at room temperature for 16 hours. Conversion to the acid chloride was confirmed by treating a sample of the reaction mixture with MeOH and the resulting bis-methyl ester was observed by LC/MS. The majority of solvent was removed by evaporation under reduced pressure; the resulting concentrated solution was re-dissolved in a minimum amount of dry DCM and triturated with diethyl ether. The resulting yellow precipitate was collected by filtration, washed with cold diethyl ether and dried for 1 hour in a vacuum oven at 40° C. The solid acid chloride was added portionwise over a period of 25 min to a stirred suspension of (2S,4R)-methyl-4-hydroxypyrrolidine-2-carboxylate hydrochloride (38.1 g, 210 mmol) and TEA (64.5 mL, g, 463 mmol) in DCM (400 mL) at −40° C. (dry ice/CH$_3$CN). Immediately, the reaction was complete as judged by LC/MS (2.47 min (ES+) m/z (relative intensity) 721 ([M+H]$^+$, 100). The mixture was diluted with DCM (200 mL) and washed with 1N HCl (300 mL), saturated NaHCO$_3$ (300 mL), brine (400 mL), dried (MgSO$_4$), filtered and the solvent evaporated in vacuo to give the pure product 6 as an orange solid (66.7 g, 100%). [α]$^{22}_D$=−46.1° (c=0.47, CHCl$_3$); $^1$H NMR (400 MHz, CDCl$_3$) (rotamers) δ 7.63 (s, 2H), 6.82 (s, 2H), 4.79-4.72 (m, 2H), 4.49-4.28 (m, 6H), 3.96 (s, 6H), 3.79 (s, 6H), 3.46-3.38 (m, 2H), 3.02 (d, 2H, J=11.1 Hz), 2.48-2.30 (m, 4H), 2.29-2.04 (m, 4H); $^{13}$C NMR (100 MHz, CDCl$_3$) (rotamers) δ 172.4, 166.7, 154.6, 148.4, 137.2, 127.0, 109.7, 108.2, 69.7, 65.1, 57.4, 57.0, 56.7, 52.4, 37.8, 29.0; IR (ATR, CHCl$_3$) 3410 (br), 3010, 2953, 1741, 1622, 1577, 1519, 1455, 1429, 1334, 1274, 1211, 1177, 1072, 1050, 1008, 871 cm$^{-1}$; MS (ES$^+$) m/z (relative intensity) 721 ([M+H]$^+$; 47), 388 (80); HRMS [M+H]$^+$ theoretical C$_{31}$H$_{36}$N$_4$O$_{16}$ m/z 721.2199, found (ES$^+$) m/z 721.2227.

(e) 1,1'-[[(Propane-1,3-diyl)dioxy]bis(11aS,2R)-2-(hydroxy)-7-methoxy-1,2,3,10,11,11a-hexahydro-5H-pyrrolo[2,1-c][1,4]-benzodiazepin-5,11-dione] (7)

Method A: A solution of the nitro-ester 6 (44 g, 61.1 mmol) in MeOH (2.8 L) was added to freshly purchased Raney® nickel (~50 g of a ~50% slurry in H$_2$O) and anti-bumping granules in a 5L 3-neck round bottomed flask. The mixture was heated at reflux and then treated dropwise with a solution of hydrazine hydrate (21.6 mL, 22.2 g, 693 mmol) in MeOH (200 mL) at which point vigorous effervescence was observed. When the addition was complete (~45 min) additional Raney® nickel was added carefully until effervescence had ceased and the initial yellow colour of the reaction mixture was discharged. The mixture was heated at reflux for a further 5 min at which point the reaction was deemed complete by TLC (90:10 v/v CHCl$_3$/MeOH) and LC/MS (2.12 min (ES+) m/z (relative intensity) 597 ([M+H]$^+$, 100)). The reaction mixture was filtered hot immediately through a sinter funnel containing celite with vacuum suction. The filtrate was reduced in volume by evaporation in vacuo at which point a colourless precipitate formed which was collected by filtration and dried in a vacuum desiccator to provide 7 (31 g, 85%). [α]$^{27}_D$=+404° (c=0.10, DMF); $^1$H NMR (400 MHz, DMSO-d$_6$) δ 10.2 (s, 2H, NH), 7.26 (s, 2H), 6.73 (s, 2H), 5.11 (d, 2H, J=3.98 Hz, OH), 4.32-4.27 (m, 2H), 4.19-4.07 (m, 6H), 3.78 (s, 6H), 3.62 (dd, 2H, J=12.1, 3.60 Hz), 3.43 (dd, 2H, J=12.0, 4.72 Hz), 2.67-2.57 (m, 2H), 2.26 (p, 2H, J=5.90 Hz), 1.99-1.89 (m, 2H);
$^{13}$C NMR (100 MHz, DMSO-d$_6$) δ 169.1, 164.0, 149.9, 144.5, 129.8, 117.1, 111.3, 104.5, 54.8, 54.4, 53.1, 33.5, 27.5; IR (ATR, neat) 3438, 1680, 1654, 1610, 1605, 1516, 1490, 1434, 1379, 1263, 1234, 1216, 1177, 1156, 1115, 1089, 1038, 1018, 952, 870 cm$^{-1}$; MS (ES$^+$) m/z (relative intensity) 619 ([M+Na]$^+$, 10), 597 ([M+H]$^+$, 52), 445 (12), 326 (11); HRMS [M+H]$^+$ theoretical C$_{29}$H$_{32}$N$_4$O$_{10}$ m/z 597.2191, found (ES$^+$) m/z 597.2205.

Method B: A suspension of 10% Pd/C (7.5 g, 10% w/w) in DMF (40 mL) was added to a solution of the nitro-ester 6 (75 g, 104 mmol) in DMF (360 mL). The suspension was hydrogenated in a Parr hydrogenation apparatus over 8 hours. Progress of the reaction was monitored by LC/MS after the hydrogen uptake had stopped. Solid Pd/C was removed by filtration and the filtrate was concentrated by rotary evaporation under vacuum (below 10 mbar) at 40° C. to afford a dark oil containing traces of DMF and residual charcoal. The residue was digested in EtOH (500 mL) at 40° C. on a water bath (rotary evaporator bath) and the resulting suspension was filtered through celite and washed with ethanol (500 mL) to give a clear filtrate. Hydrazine hydrate (10 mL, 321 mmol) was added to the solution and the reaction mixture was heated at reflux. After 20 minutes the formation of a white precipitate was observed and reflux was allowed to continue for a further 30 minutes. The mixture was allowed to cool down to room temperature and the precipitate was retrieved by filtration, washed with diethyl ether (2:1 volume of precipitate) and dried in a vacuum desiccator to provide 7 (50 g, 81%). Analytical data for method B: Identical to those obtained for Method A (optical rotation, $^1$H NMR, LC/MS and TLC).

(f) 1,1'-[[(Propane-1,3-diyl)dioxy]bis(11aS,2R)-2-(tert-butyldimethylsilyloxy)-7-methoxy-1,2,3,10,11,11a-hexahydro-5H-pyrrolo[2,1-c][1,4]-benzodiazepin-5,11-dione] (8)

TBSCl (27.6 g, 182.9 mmol) and imidazole (29.9 g, 438.8 mmol) were added to a cloudy solution of the tetralactam 7 (21.8 g, 36.6 mmol) in anhydrous DMF (400 mL) at 0° C. (ice/acetone). The mixture was allowed to stir under a nitrogen atmosphere for 3 hours after which time the reaction was deemed complete as judged by LC/MS (3.90 min (ES+) m/z (relative intensity) 825 ([M+H]$^+$, 100). The reaction mixture was poured onto ice (~1.75 L) and allowed to warm to room temperature with stirring. The resulting white precipitate was collected by vacuum filtration, washed with H$_2$O, diethyl ether and dried in the vacuum desicator to provide pure 8 (30.1 g, 99%). [α]$^{23}_D$=+234° (c=0.41, CHCl$_3$); $^1$H NMR (400 MHz, CDCl$_3$) δ 8.65 (s, 2H, NH), 7.44 (s, 2H), 6.54 (s, 2H), 4.50 (p, 2H, J=5.38 Hz), 4.21-4.10 (m, 6H), 3.87 (s, 6H), 3.73-3.63 (m, 4H), 2.85-2.79 (m, 2H), 2.36-2.29 (m, 2H), 2.07-1.99 (m, 2H), 0.86 (s, 18H), 0.08 (s, 12H); $^{13}$C NMR (100 MHz, CDCl$_3$) δ 170.4, 165.7, 151.4, 146.6, 129.7, 118.9, 112.8, 105.3, 69.2, 65.4, 56.3, 55.7, 54.2, 35.2, 28.7, 25.7, 18.0, −4.82 and −4.86; IR (ATR, CHCl$_3$) 3235, 2955, 2926, 2855, 1698, 1695, 1603, 1518, 1491, 1446, 1380, 1356, 1251, 1220, 1120, 1099, 1033 cm$^{-1}$; MS (ES$^+$) m/z (relative intensity) 825 ([M+H]$^+$, 62), 721 (14), 440 (38); HRMS [M+H]$^+$ theoretical C$_{41}$H$_{60}$N$_4$O$_{10}$Si$_2$ m/z 825.3921, found (ES$^+$) m/z 825.3948.

(g) 1,1'-[[(Propane-1,3-diyl)dioxy]bis(11aS,2R)-2-(tert-butyldimethylsilyloxy)-7-methoxy-10-((2-(trimethylsilyl)ethoxy)methyl)-1,2,3,10,11,11a-hexahydro-5H-pyrrolo[2,1-c][1,4]-benzodiazepin-5,11-dione] (9)

A solution of n-BuLi (68.3 mL of a 1.6 M solution in hexane, 109 mmol) was added dropwise to a stirred suspension of the tetralactam 8 (30.08 g, 36.4 mmol) in anhydrous THF (600 mL) at −30° C. (dry ice/ethylene glycol) under a nitrogen atmosphere. The reaction mixture was allowed to stir at this temperature for 1 hour (now a reddish orange colour) at which point a solution of SEMCl (19.3 mL, 18.2 g, 109 mmol) in anhydrous THF (120 mL) was added dropwise. The reaction mixture was allowed to slowly warm to room temperature and was stirred for 16 hours under a nitrogen atmosphere. The reaction was deemed complete as judged by TLC (EtOAc) and LC/MS (4.77 min (ES+) m/z (relative intensity) 1085 ([M+H]$^+$, 100). The THF was removed by evaporation in vacuo and the resulting residue dissolved in EtOAc (750 mL), washed with H$_2$O (250 mL), brine (250 mL), dried (MgSO$_4$) filtered and evaporated in vacuo to provide the crude N10-SEM-protected tetralactam 9 as an oil (max$^m$ 39.5 g, 100%). Product carried through to next step without purification. [α]$^{23}_D$=+163° (c=0.41, CHCl$_3$); $^1$H NMR (400 MHz, CDCl$_3$) δ 7.33 (s, 2H), 7.22 (s, 2H), 5.47 (d, 2H, J=9.98 Hz), 4.68 (d, 2H, J=9.99 Hz), 4.57 (p, 2H, J=5.77 Hz), 4.29-4.19 (m, 6H), 3.89 (s, 6H), 3.79-3.51 (m, 8H), 2.87-2.81 (m, 2H), 2.41 (p, 2H, J=5.81 Hz), 2.03-1.90 (m, 2H), 1.02-0.81 (m, 22H), 0.09 (s, 12H), 0.01 (s, 18H); $^{13}$C NMR (100 MHz, CDCl$_3$) δ 170.0, 165.7, 151.2, 147.5, 133.8, 121.8, 111.6, 106.9, 78.1, 69.6, 67.1, 65.5, 56.6, 56.3, 53.7, 35.6, 30.0, 25.8, 18.4, 18.1, −1.24, −4.73; IR (ATR, CHCl$_3$) 2951, 1685, 1640, 1606, 1517, 1462, 1433, 1360, 1247, 1127, 1065 cm$^{-1}$; MS (ES$^+$) m/z (relative intensity) 1113 ([M+Na]$^+$, 48), 1085 ([M+H]$^+$, 100), 1009 (5), 813 (6); HRMS [M+H]$^+$ theoretical C$_{53}$H$_{88}$N$_4$O$_{12}$Si$_4$ m/z 1085.5548, found (ES$^+$) m/z 1085.5542.

(h) 1,1'-[[(Propane-1,3-diyl)dioxy]bis(11aS,2R)-2-hydroxy-7-methoxy-10-((2-(trimethylsilyl)ethoxy)methyl)-1,2,3,10,11,11a-hexahydro-5H-pyrrolo[2,1-c][1,4]-benzodiazepin-5,11-dione] (10)

A solution of TBAF (150 mL of a 1.0 M solution in THF, 150 mmol) was added to a stirred solution of the crude bis-silyl ether 9 [84.0 g (max$^m$ 56.8 g), 52.4 mmol] in THF (800 mL) at room temperature. After stirring for 1 hour, analysis of the reaction mixture by TLC (95:5 v/v CHCl$_3$/MeOH) revealed completion of reaction. The THF was removed by evaporation under reduced pressure at room temperature and the resulting residue dissolved in EtOAc (500 mL) and washed with NH$_4$Cl (300 mL). The combined organic layers were washed with brine (60 mL), dried (MgSO$_4$), filtered and evaporated under reduced pressure to provide the crude product. Purification by flash chromatography (gradient elution: 100% CHCl$_3$ to 96:4 v/v CHCl$_3$/MeOH) gave the pure tetralactam 10 as a white foam (36.0 g, 79%). LC/MS 3.33 min (ES+) m/z (relative intensity) 879 ([M+Na]$^+$, 100), 857 ([M+H]$^+$, 40); [α]$^{23}_D$=+202° (c=0.34, CHCl$_3$); $^1$H NMR (400 MHz, CDCl$_3$) δ 7.28 (s, 2H), 7.20 (s, 2H), 5.44 (d, 2H, J=10.0 Hz), 4.72 (d, 2H, J=10.0 Hz), 4.61-4.58 (m, 2H), 4.25 (t, 4H, J=5.83 Hz), 4.20-4.16 (m, 2H), 3.91-3.85 (m, 8H), 3.77-3.54 (m, 6H), 3.01 (br s, 2H, OH), 2.96-2.90 (m, 2H), 2.38 (p, 2H, J=5.77 Hz), 2.11-2.05 (m, 2H), 1.00-0.91 (m, 4H), 0.00 (s, 18H); $^{13}$C NMR (100 MHz, CDCl$_3$) δ 169.5, 165.9, 151.3, 147.4, 133.7, 121.5, 111.6, 106.9, 79.4, 69.3, 67.2, 65.2, 56.5, 56.2, 54.1, 35.2, 29.1, 18.4, −1.23; IR (ATR, CHCl$_3$) 2956, 1684, 1625, 1604, 1518, 1464, 1434, 1361, 1238, 1058, 1021 cm$^{-1}$; MS (ES$^+$) m/z (relative intensity) 885 ([M+29]$^+$, 70), 857 ([M+H]$^+$, 100), 711 (8), 448 (17); HRMS [M+H]$^+$ theoretical C$_{41}$H$_{60}$N$_4$O$_{12}$Si$_2$ m/z 857.3819, found (ES$^+$) m/z 857.3826.

(i) 1,1'-[[(Propane-1,3-diyl)dioxy]bis(11aS)-7-methoxy-2-oxo-10-((2-(trimethylsilyl)ethoxy)methyl)-1,2,3,10,11,11a-hexahydro-5H-pyrrolo[2,1-c][1,4]-benzodiazepin-5,11-dione] (11)

Diol 10 (25.6 g, 30 mmol, 1 eq.), NaOAc (6.9 g, 84 mmol, 2.8 eq.) and TEMPO (188 mg, 1.2 mmol, 0.04 eq.) were dissolved in DCM (326 mL) under Ar. This was cooled to −8° C. (internal temperature) and TCCA (9.7 g, 42 mmol, 1.4 eq.) was added portionwise over 15 minutes. TLC (EtOAc) and LC/MS [3.60 min. (ES+) m/z (relative intensity) 854.21 ([M+H]$^+$, 40), (ES−) m/z (relative intensity) 887.07 ([M−H+Cl]$^-$, 10)] after 30 minutes indicated that reaction was complete. Cold DCM (200 mL) was added and the mixture was filtered through a pad of Celite before washing with a solution of saturated sodium hydrogen carbonate/sodium thiosulfate (1:1 v/v; 200 mL×2). The organic layer was dried with MgSO$_4$, filtered and the solvent removed in vacuo to yield a yellow/orange sponge (25.4 g, 99%). LC/MS [3.60 min. (ES+) m/z (relative intensity) 854.21 ([M+H]$^+$, 40); [α]$^{20}_D$=+291° (c=0.26, CHCl$_3$); $^1$H NMR (400 MHz, CDCl$_3$) δ 7.32 (s, 2H), 7.25 (s, 2H), 5.50 (d, 2H, J=10.1 Hz), 4.75 (d, 2H, J=10.1 Hz), 4.60 (dd, 2H, J=9.85, 3.07 Hz), 4.31-4.18 (m, 6H), 3.89-3.84 (m, 8H), 3.78-3.62 (m, 4H), 3.55 (dd, 2H, J=19.2, 2.85 Hz), 2.76 (dd, 2H, J=19.2, 9.90 Hz), 2.42 (p, 2H, J=5.77 Hz), 0.98-0.91 (m, 4H), 0.00 (s, 18H); $^{13}$C NMR (100 MHz, CDCl$_3$) δ 206.8, 168.8, 165.9, 151.8, 148.0, 133.9, 120.9, 111.6, 107.2, 78.2, 67.3, 65.6, 56.3, 54.9, 52.4, 37.4, 29.0, 18.4, −1.24; IR (ATR, CHCl$_3$) 2957, 1763, 1685, 1644, 1606, 1516, 1457, 1434, 1360, 1247, 1209, 1098, 1066, 1023 cm$^{-1}$; MS (ES$^+$) m/z (relative intensity) 881 ([M+29]$^+$, 38), 853 ([M+H]$^+$, 100), 707 (8), 542 (12); HRMS [M+H]$^+$ theoretical C$_{41}$H$_{56}$N$_4$O$_{12}$Si$_2$ m/z 853.3506, found (ES$^+$) m/z 853.3502.

(j) 1,1'-[[(Propane-1,3-diyl)dioxy]bis(11aS)-7-methoxy-2-[[(trifluoromethyl)sulfonyl]oxy]-10-((2-(trimethylsilyl)ethoxy)methyl)-1,10,11,11a-tetrahydro-5H-pyrrolo[2,1-c][1,4]-benzodiazepin-5,11-dione] (12)

Anhydrous 2,6-lutidine (5.15 mL, 4.74 g, 44.2 mmol) was injected in one portion to a vigorously stirred solution of bis-ketone 11 (6.08 g, 7.1 mmol) in dry DCM (180 mL) at −45° C. (dry ice/acetonitrile) under a nitrogen atmosphere. Anhydrous triflic anhydride, taken from a freshly opened ampoule (7.2 mL, 12.08 g, 42.8 mmol), was injected rapidly dropwise, while maintaining the temperature at −40° C. or below. The reaction mixture was allowed to stir at −45° C. for 1 hour at which point TLC (50/50 v/v n-hexane/EtOAc) revealed the complete consumption of starting material. The cold reaction mixture was immediately diluted with DCM (200 mL) and, with vigorous shaking, washed with water (1×100 mL), 5% citric acid solution (1×200 mL) saturated NaHCO$_3$ (200 mL), brine (100 mL) and dried (MgSO$_4$). Filtration and evaporation of the solvent under reduced pressure afforded the crude product which was purified by flash column chromatography (gradient elution: 90:10 v/v n-hexane/EtOAc to 70:30 v/v n-hexane/EtOAc) to afford bis-enol triflate 12 as a yellow foam (5.5 g, 70%). LC/MS 4.32 min (ES+) m/z (relative intensity) 1139 ([M+Na]$^+$, 20); [α]24$_D$=+271° (c=0.18, CHCl$_3$); $^1$H NMR (400 MHz, CDCl$_3$) δ 7.33 (s, 2H), 7.26 (s, 2H), 7.14 (t, 2H, J=1.97 Hz), 5.51 (d, 2H, J=10.1 Hz), 4.76 (d, 2H, J=10.1 Hz), 4.62 (dd, 2H, J=11.0, 3.69 Hz), 4.32-4.23 (m, 4H), 3.94-3.90 (m, 8H), 3.81-3.64 (m, 4H), 3.16 (ddd, 2H, J=16.3, 11.0, 2.36 Hz), 2.43 (p, 2H, J=5.85 Hz), 1.23-0.92 (m, 4H), 0.02 (s, 18H); $^{13}$C NMR (100 MHz, CDCl$_3$) δ 167.1, 162.7, 151.9, 148.0, 138.4, 133.6, 120.2, 118.8, 111.9, 107.4, 78.6, 67.5, 65.6, 56.7, 56.3, 30.8, 29.0, 18.4,−1.25; IR (ATR, CHCl$_3$) 2958, 1690, 1646, 1605, 1517, 1456, 1428, 1360, 1327, 1207, 1136, 1096, 1060, 1022, 938, 913 cm$^{-1}$; MS (ES$^+$) m/z (relative intensity) 1144 ([M+28]$^+$, 100), 1117 ([M+H]$^+$, 48), 1041 (40), 578 (8); HRMS [M+H]$^+$ theoretical C$_{43}$H$_{54}$N$_4$O$_{16}$Si$_2$S$_2$F$_6$ m/z 1117.2491, found (ES$^+$) m/z 1117.2465.

Synthesis of Intermediate 15

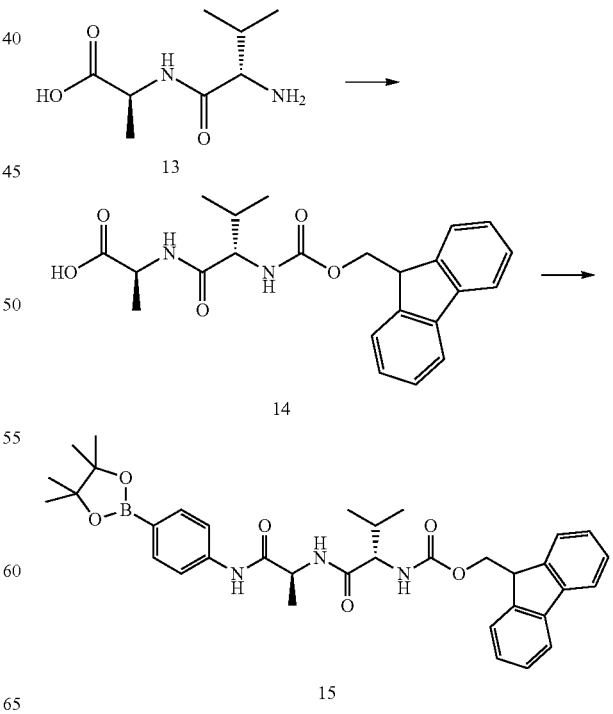

(a) (R)-2-((R)-2-((((9H-fluoren-9-yl)methoxy)carbonyl)amino)-3-methylbutanamido)propanoic acid (14)

HO-Ala-Val-H 13 (350 mg, 1.86 mmol) and Na$_2$CO$_3$ (493 mg, 4.65 mmol) were dissolved in distilled H$_2$O (15 mL) and the mixture was cooled to 0° C. before dioxane (15 mL) was added (partial precipitation of the amino acid salt occurred). A solution of Fmoc-Cl (504 mg, 1.95 mmol) in dioxane (15 mL) was added dropwise with vigorous stirring over 10 minutes. The resulting mixture was stirred at 0° C. for 2 hours before the ice bath was removed and stirring was maintained for 16 hours. The solvent was removed by rotary evaporation under reduced pressure and the residue dissolved in water (150 mL). The pH was adjusted from 9 to 2 with 1N HCl and the aqueous layer was subsequently extracted with EtOAc (3×100 mL). The combined organics were washed with brine (100 mL), dried with MgSO$_4$, filtered and the volatiles removed by rotary evaporation under reduced pressure to afford pure HO-Ala-Val-Fmoc 14 (746 mg, 97% yield). LC/MS 2.85 min (ES+) m/z (relative intensity) 410.60; $^1$H-NMR (400 MHz, CDCl$_3$) δ 7.79 (d, J=7.77 Hz, 2H), 7.60 (d, J=7.77 Hz, 2H), 7.43 (d, J=7.5 Hz, 2H), 7.34 (d, J=7.5 Hz, 2H), 6.30 (bs, 1H), 5.30 (bs, 1H), 4.71-7.56 (m, 1H), 4.54-4.36 (m, 2H), 4.08-3.91 (m, 1H), 2.21-2.07 (m, 1H), 1.50 (d, J=7.1 Hz, 3H), 1.06-0.90 (m, 6H).

(b) (9H-fluoren-9-yl)methyl((S)-3-methyl-1-oxo-1-(((S)-1-oxo-1-((4-(4,4,5,5-tetramethyl-1,3,2-dioxaborolan-2-yl)phenyl)amino)propan-2-yl)amino)butan-2-yl)carbamate (15)

4-Aminophenylboronic acid pinacol ester was added (146.9 mg, 0.67 mmol) was added to a solution of HO-Ala-Val-Fmoc 14 (330 mg, 0.8 mmol), DCC (166 mg, 0.8 mmol) and DMAP (5 mg, cat.) in dry DCM (8 mL) previously stirred for 30 minutes at room temperature in a flask flushed with argon. The reaction mixture was then allowed to stir at room temperature overnight. The reaction was followed by LCMS and TLC. The reaction mixture was diluted with CH$_2$Cl$_2$ and the organics were washed with H$_2$O and brine before being dried with MgSO$_4$, filtered and the solvent removed by rotary evaporation under reduced pressure. The crude product was dryloaded on a silicagel chromatography column (Hexane/EtOAc, 6:4) and pure product 15 was isolated as a white solid in 88% yield (360 mg).

Example 1

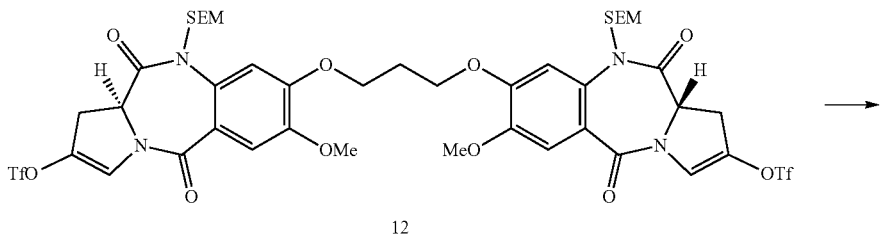

12

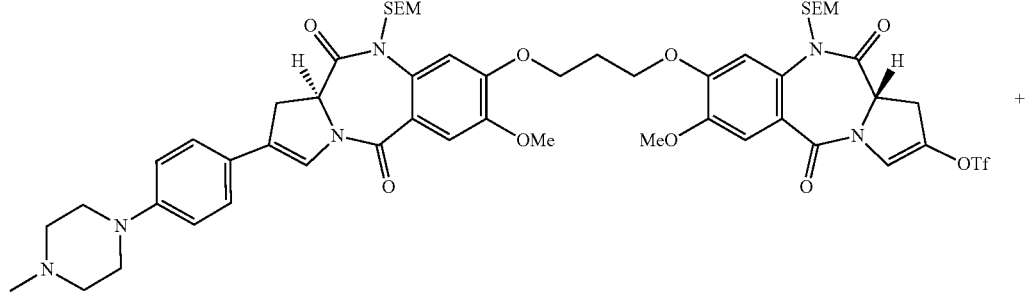

16

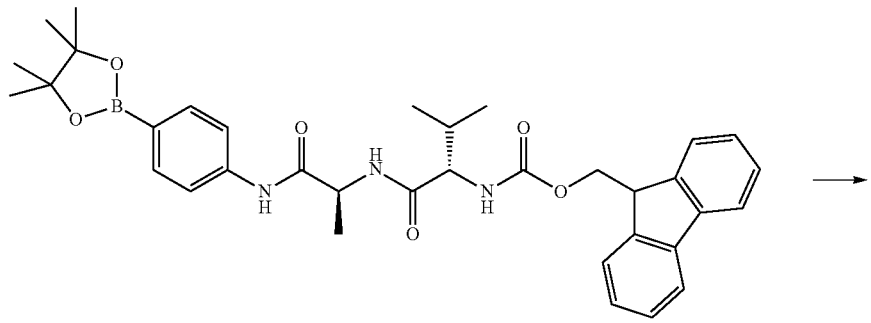

15

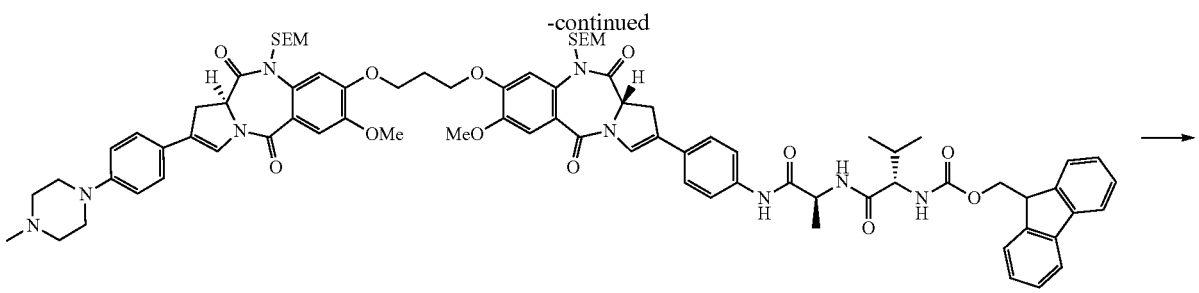

17

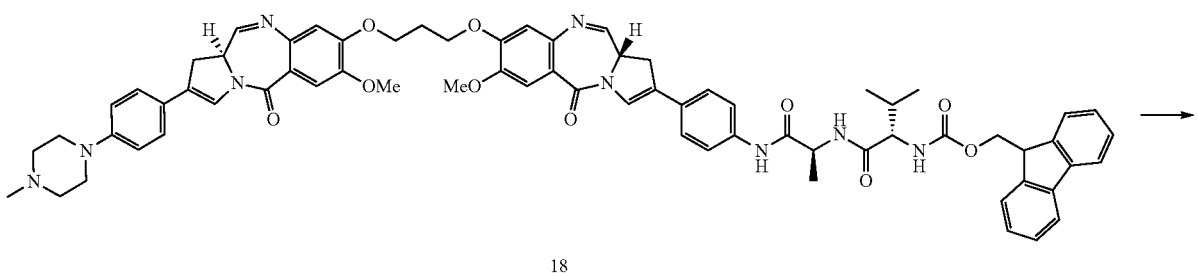

18

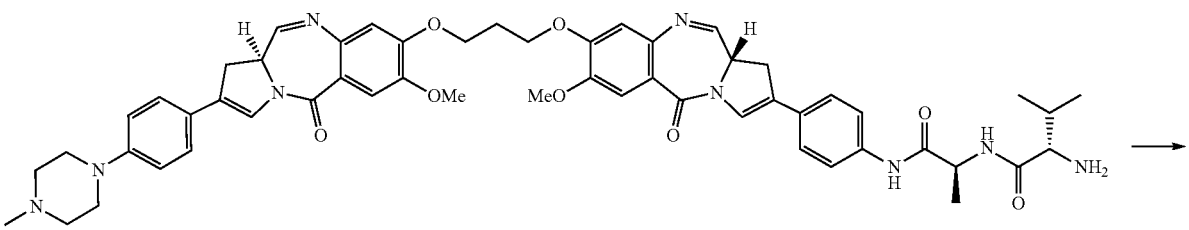

19

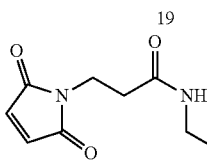

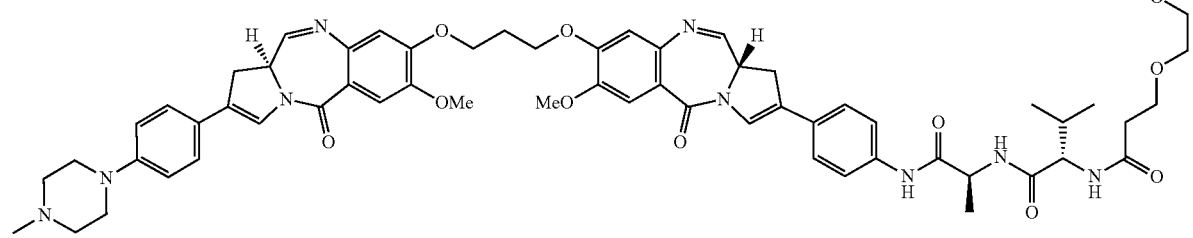

20

(a) (S)-7-methoxy-8-(3-(((S)-7-methoxy-2-(4-(4-methylpiperazin-1-yl)phenyl)-5,11-dioxo-10-((2-(trimethylsilyl)ethoxy)methyl)-5,10,11,11a-tetrahydro-1H-pyrrolo[2,1-c][1,4]benzodiazepin-8-yl)oxy)propoxy)-5,11-dioxo-10-((2-(trimethylsilyl)ethoxy)methyl)-5,10,11,11a-tetrahydro-1H-pyrrolo[2,1-c][1,4]benzodiazepin-2-yl trifluoromethanesulfonate (16)

Pd(PPh$_3$)$_4$ (20.6 mg, 0.018 mmol) was added to a stirred mixture of the bis-enol triflate 12 (500 mg, 0.44 mmol), N-methyl piperazine boronic ester (100 mg, 0.4 mmol), Na$_2$CO$_3$ (218 mg, 2.05 mmol), MeOH (2.5 mL), toluene (5 mL) and water (2.5 mL). The reaction mixture was allowed to stir at 30° C. under a nitrogen atmosphere for 24 hours after which time all the boronic ester has consumed. The reaction mixture was then evaporated to dryness before the residue was taken up in EtOAc (100 mL) and washed with H$_2$O (2×50 mL), brine (50 mL), dried (MgSO$_4$), filtered and evaporated under reduced pressure to provide the crude product. Purification by flash chromatography (gradient elution: 80:20 v/v Hexane/EtOAc to 60:40 v/v Hexane/EtOAc) afforded product 16 as a yellowish foam (122.6 mg, 25%). LC/MS 3.15 min (ES+) m/z (relative intensity) 1144 ([M+H]$^+$, 20%).

(b) (9H-fluoren-9-yl)methyl ((S)-1-(((S)-1-((4-((S)-7-methoxy-8-(3-(((S)-7-methoxy-2-(4-(4-methylpiperazin-1-yl)phenyl)-5,11-dioxo-10-((2-(trimethylsilyl)ethoxy)methyl)-5,10,11,11a-tetrahydro-1H-pyrrolo[2,1-c][1,4]benzodiazepin-8-yl)oxy)propoxy)-5,11-dioxo-10-((2-(trimethylsilyl)ethoxy)methyl)-5,10,11,11a-tetrahydro-1H-pyrrolo[2,1-c][1,4]benzodiazepin-2-yl)phenyl)amino)-1-oxopropan-2-yl)amino)-3-methyl-1-oxobutan-2-yl)carbamate (17)

PBD-triflate 16 (359 mg, 0.314 mmol), boronic pinacol ester 15 (250 mg, 0.408 mmol) and triethylamine (0.35 mL, 2.51 mmol) were dissolved in a mixture of toluene/MeOH/$H_2O$, 2:1:1 (3 mL). The microwave vessel was purged and filled with argon three times before tetrakis(triphenylphosphine)palladium(0) (21.7 mg, 0.018 mmol) was added and the reaction mixture placed in the microwave at 80° C. for 10 minutes. Subsequently, $CH_2Cl_2$ (100 mL) was added and the organics were washed with water (2×50 mL) and brine (50 mL) before being dried with $MgSO_4$, filtered and the volatiles removed by rotary evaporation under reduced pressure. The crude product was purified by silica gel chromatography column ($CHCl_3$/MeOH, 100% to 9:1) to afford pure 17 (200 mg, 43% yield). LC/MS 3.27 min (ES+) m/z (relative intensity) 1478 ([M+H]$^+$, 100%).

(c) (9H-fluoren-9-yl)methyl((S)-1-(((S)-1-((4-((S)-7-methoxy-8-(3-(((S)-7-methoxy-2-(4-(4-methylpiperazin-1-yl)phenyl)-5-oxo-5,11a-dihydro-1H-pyrrolo[2,1-c][1,4]benzodiazepin-8-yl)oxy)propoxy)-5-oxo-5,11a-dihydro-1H-pyrrolo[2,1-c][1,4]benzodiazepin-2-yl)phenyl)amino)-1-oxopropan-2-yl)amino)-3-methyl-1-oxobutan-2-yl)carbamate (18)

A solution of Super-Hydride® (0.34 mL, 1M in THF) was added dropwise to a solution of SEM-dilactam 17 (200 mg, 0.135 mmol) in THF (5 mL) at −78° C. under an argon atmosphere. The addition was completed over 5 minutes in order to maintain the internal temperature of the reaction mixture constant. After 20 minutes, an aliquot was quenched with water for LC/MS analysis, which revealed that the reaction was complete. Water (20 mL) was added to the reaction mixture and the cold bath was removed. The organic layer was extracted with EtOAc (3×30 mL) and the combined organics were washed with brine (50 mL), dried with $MgSO_4$, filtered and the solvent removed by rotary evaporation under reduced pressure. The crude product was dissolved in MeOH (6 mL), $CH_2Cl_2$ (3 mL), water (1 mL) and enough silica gel to form a thick stirring suspension. After 5 days, the suspension was filtered through a sintered funnel and washed with $CH_2Cl_2$/MeOH (9:1) (100 mL) until the elution of the product was complete. The organic layer was washed with brine (2×50 mL), dried with $MgSO_4$, filtered and the solvent removed by rotary evaporation under reduced pressure. Purification by silica gel column chromatography (100% $CHCl_3$ to 96% $CHCl_3$/4% MeOH) afforded the product 18 as a yellow solid (100 mg, 63%). LC/MS 2.67 min (ES+) m/z (relative intensity) 1186 ([M+H]$^+$, 5%).

(d) (S)-2-amino-N—((S)-1-((4-((R)-7-methoxy-8-(3-(((R)-7-methoxy-2-(4-(4-methylpiperazin-1-yl)phenyl)-5-oxo-5,11a-dihydro-1H-pyrrolo[2,1-c][1,4]benzodiazepin-8-yl)oxy)propoxy)-5-oxo-5,11a-dihydro-1H-pyrrolo[2,1-c][1,4]benzodiazepin-2-yl)phenyl)amino)-1-oxopropan-2-yl)-3-methylbutanamide (19)

Excess piperidine was added (0.1 mL, 1 mmol) to a solution of PBD 18 (36.4 mg, 0.03 mmol) in DMF (0.9 mL). The mixture was allowed to stir at room temperature for 20 min, at which point the reaction had gone to completion (as monitored by LC/MS). The reaction mixture was diluted with $CH_2Cl_2$ (50 mL) and the organic phase was washed with $H_2O$ (3×50 mL) until complete piperidine removal. The organic phase was dried over $MgSO_4$, filtered and excess solvent removed by rotary evaporation under reduced pressure to afford crude product 19 which was used as such in the next step. LC/MS 2.20 min (ES+) m/z (relative intensity) 964 ([M+H]$^+$, 5%).

(e) 1-(3-(2, 5-dioxo-2,5-dihydro-1H-pyrrol-1-yl)propanamido)-N-((2S)-1-(((2S)-1-((4-(7-methoxy-8-(3-((7-methoxy-2-(4-(4-methylpiperazin-1-yl)phenyl)-5-oxo-5,11a-dihydro-1H-benzo[e]pyrrolo[1,2-a][1,4]diazepin-8-yl)oxy)propoxy)-5-oxo-5,11a-dihydro-1H-benzo[e]pyrrolo[1,2-a][1,4]diazepin-2-yl)phenyl)amino)-1-oxopropan-2-yl)amino)-3-methyl-1-oxobutan-2-yl)-3,6,9,12,15,18,21,24-octaoxaheptacosan-27-amide (20)

EDCl hydrochloride (8 mg, 0.042 mmol) was added to a suspension of Maleimide-$PEG_8$-acid (25 mg, 0.042 mmol) in dry $CH_2Cl_2$ (4 mL) under argon atmosphere. PBD 19 (42 mg, crude) was added straight away and stirring was maintained until the reaction was complete (3 hours). The reaction was diluted with $CH_2Cl_2$ and the organic phase was washed with $H_2O$ and brine before being dried over $MgSO_4$, filtered and excess solvent removed by rotary evaporation under reduced pressure by rotary evaporation under reduced pressure. The product was purified by careful silica gel chromatography (slow elution starting with 100% $CHCl_3$ up to 9:1 $CHCl_3$/MeOH) followed by reverse phase HPLC to remove unreacted maleimide-$PEG_8$-acid. The product 20 was isolated in 10% over two steps (6.6 mg). LC/MS 1.16 min (ES+) m/z (relative intensity) 770.20 ([M+2H]$^+$, 40%).

Example 2

Alternative Synthesis of Compound 17

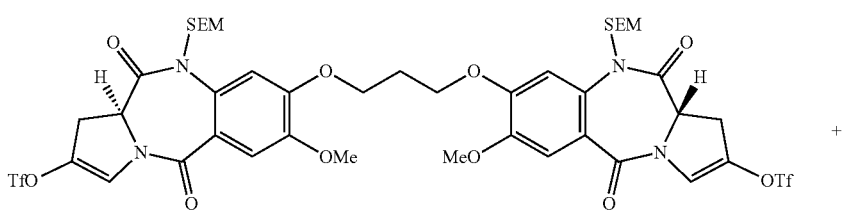

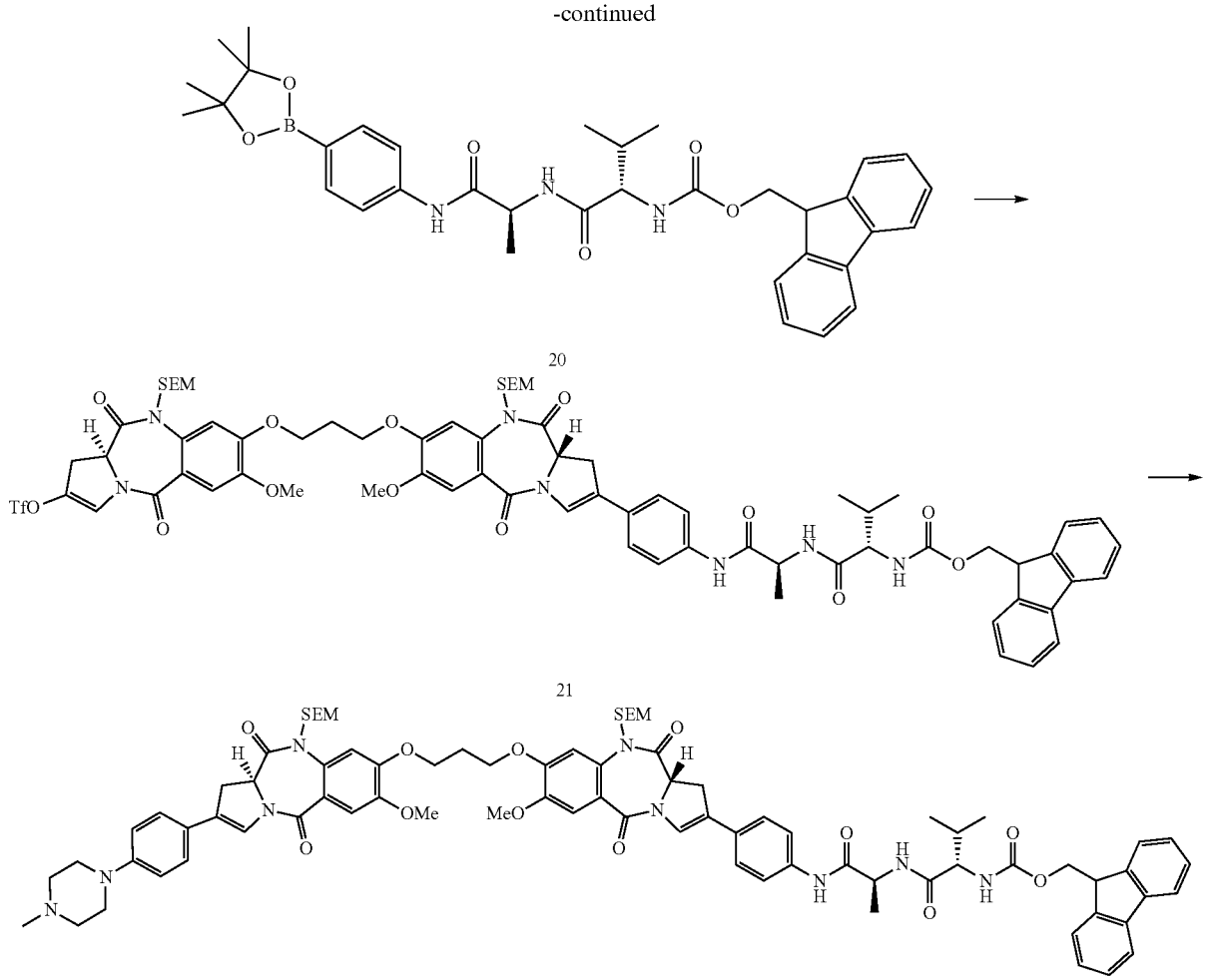

(a) 8-(3-((2-(4-(S)-2-((S)-2-((((9H-fluoren-9-yl)methoxy)carbonyl)amino)-3-methylbutanamido)propanamido)phenyl)-7-methoxy-5,11-dioxo-10-((2-(trimethylsilyl)ethoxy)methyl)-5,10,11,11a-tetrahydro-1H-benzo[e]pyrrolo[1,2-a][1,4]diazepin-8-yl)oxy)propoxy)-7-methoxy-5,11-dioxo-10-((2-(trimethylsilyl)ethoxy)methyl)-5,10,11,11a-tetrahydro-1H-benzo[e]pyrrolo[1,2-a][1,4]diazepin-2-yl trifluoromethanesulfonate (21)

Bis-triflate 12 (2.03 g, 1.81 mmol), boronic pinacol ester 20 (1 g, 1.63 mmol) and Na$_2$CO$_3$ (881 mg, 8.31 mmol) were dissolved in a mixture of toluene/MeOH/H$_2$O, 2:1:1 (40 mL). The reaction flask was purged and filled with argon three times before tetrakis(triphenylphosphine)palladium(0) (41 mg, 0.035 mmol) was added and the reaction mixture heated to 30° C. overnight. The solvents were removed under reduce pressure and the residue was taken up in H$_2$O (100 mL) and extracted with EtOAc (3×100 mL). The combined organics were washed with brine (100 mL), dried with MgSO$_4$, filtered and the volatiles removed by rotary evaporation under reduced pressure. The crude product was purified by silica gel chromatography column (Hexane/EtOAc, 8:2 to 25:75) to afford pure 21 in 33% yield (885 mg). LC/MS 3.85 min (ES+) m/z (relative intensity) 1452.90; $^1$H NMR (400 MHz, CDCl$_3$) δ 7.78-7.16 (m, 17H), 7.13 (s, 1H), 6.51-6.24 (m, 1H), 5.51 (dd, J=10.0, 5.1 Hz, 2H), 5.36-5.11 (m, 1H), 4.74 (dd, J=10.1, 4.4 Hz, 2H), 4.70-4.53 (m, 2H), 4.47 (d, J=6.4 Hz, 1H), 4.37 (d, J=7.2 Hz, 1H), 4.27 (m, 4H), 4.20-4.14 (m, 1H), 3.90 (s, 3H), 3.89 (s, 3H), 3.77 (ddd, J=16.7, 9.0, 6.4 Hz, 3H), 3.71-3.61 (m, 2H), 3.24-2.91 (m, 3H), 2.55-2.33 (m, 2H), 2.22-2.07 (m, 1H), 1.52-1.37 (m, 3H), 1.04-0.86 (m, 10H), 0.00 (s, 18H).

(b) (9H-fluoren-9-yl)methyl ((S)-1-(((S)-1-((4-((S)-7-methoxy-8-(3-(((S)-7-methoxy-2-(4-(4-methylpiperazin-1-yl)phenyl)-5,11-dioxo-10-((2-(trimethylsilyl)ethoxy)methyl)-5,10,11,11a-tetrahydro-1H-pyrrolo[2,1-c][1,4]benzodiazepin-8-yl)oxy)propoxy)-5,11-dioxo-10-((2-(trimethylsilyl)ethoxy)methyl)-5,10,11,11a-tetrahydro-1H-pyrrolo[2,1-c][1,4]benzodiazepin-2-yl)phenyl)amino)-1-oxopropan-2-yl)amino)-3-methyl-1-oxobutan-2-yl)carbamate (17)

PBD-triflate 21 (469 mg, 0.323 mmol), boronic pinacol ester (146.5 mg, 0.484 mmol) and Na$_2$CO$_3$ (157 mg, 1.48 mmol) were dissolved in a mixture of toluene/MeOH/H$_2$O, 2:1:1 (10 mL). The reaction flask was purged with argon three times before tetrakis(triphenylphosphine)palladium(0) (7.41 mg, 0.0064 mmol) was added and the reaction mixture heated to 30° C. overnight. The solvents were removed under reduced pressure and the residue was taken up in H₂O (50 mL) and extracted with EtOAc (3×50 mL). The combined organics were washed with brine (100 mL), dried with MgSO₄, filtered and the volatiles removed by rotary evaporation under reduced pressure. The crude product was purified by silica gel column chromatography (CHCl₃ 100% to CHCl₃/MeOH 95%:5%) to afford pure 17 in 33% yield (885 mg). LC/MS 3.27 min (ES+) m/z (relative intensity) 1478 ([M+H]⁺, 100%).

Example 3

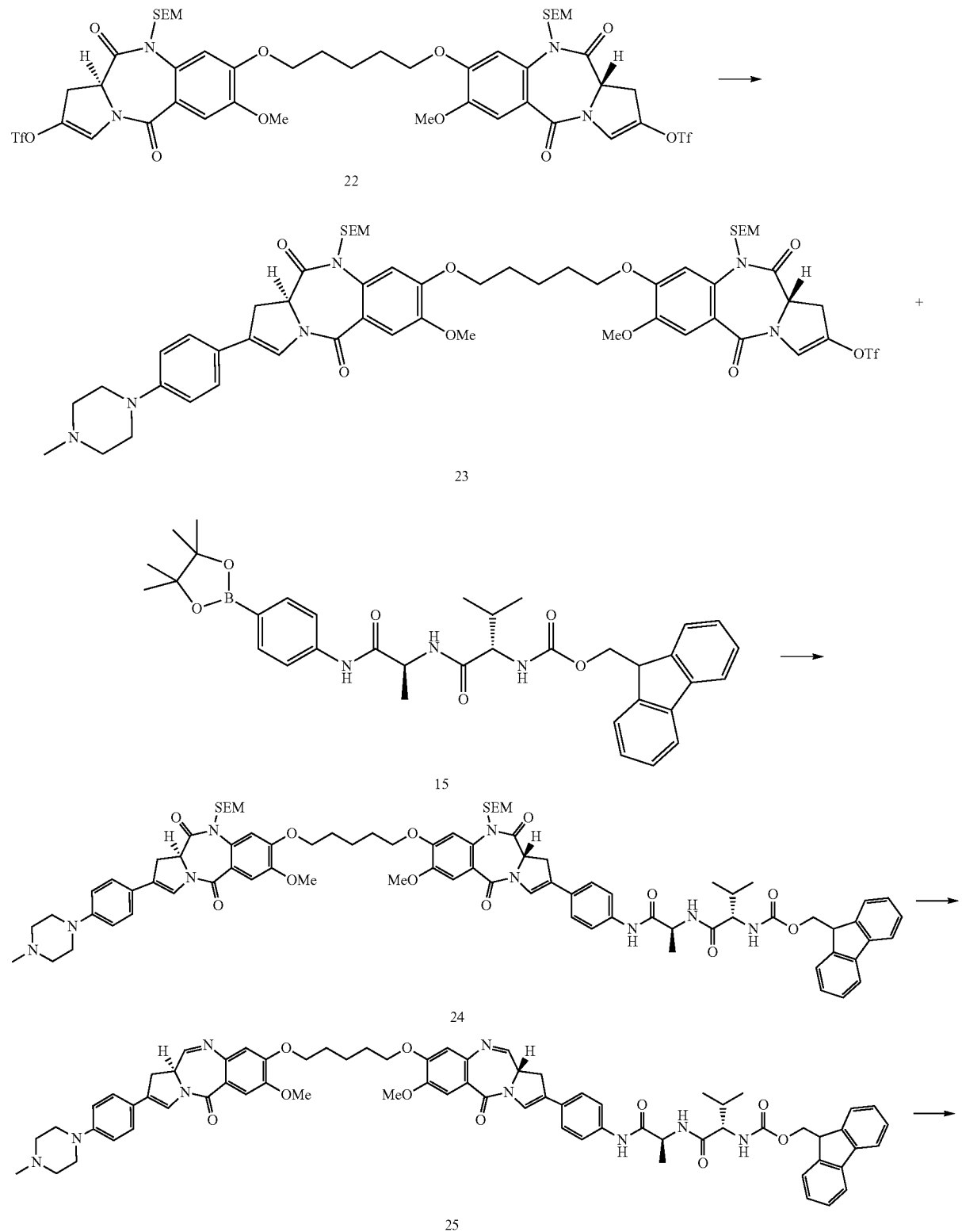

-continued

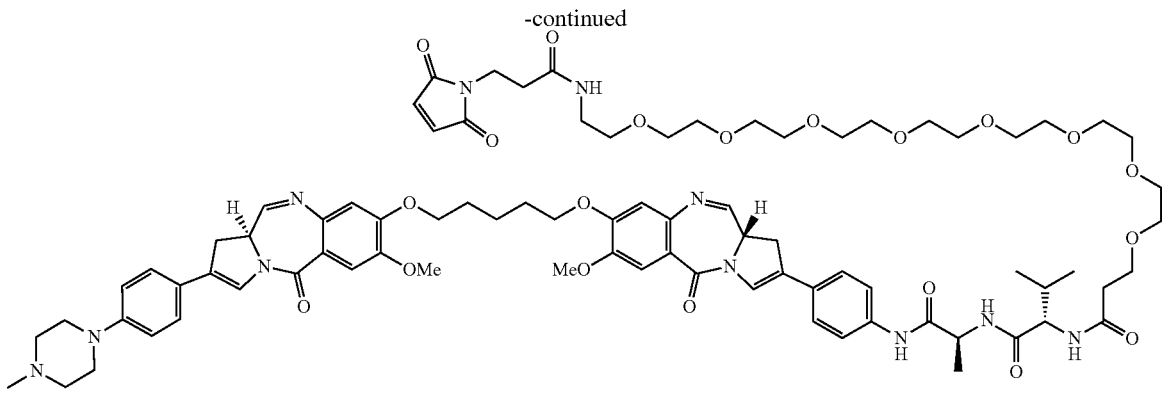

26

(a) (S)-7-methoxy-8-((5-(((S)-7-methoxy-2-(4-(4-methylpiperazin-1-yl)phenyl)-5,11-dioxo-10-((2-(trimethylsilyl)ethoxy)methyl)-5,10,11,11a-tetrahydro-1H-benzo[e]pyrrolo[1,2-a][1,4]diazepin-8-yl)oxy)pentyl)oxy)-5,11-dioxo-10-((2-(trimethylsilyl)ethoxy)methyl)-5,10,11,11a-tetrahydro-1H-benzo[e]pyrrolo[1,2-a][1,4]diazepin-2-yl trifluoromethanesulfonate (23)

Pd(PPh₃)₄ (30 mg, 26 μmol) was added to a stirred mixture of the bis-enol triflate 22 (1 g, 0.87 mmol), 4-(4-methylpiperazin-1-yl)phenylboronic acid, pinacol ester (264 mg, 0.87 mmol), Na₂CO₃ (138 mg, 1.30 mmol), EtOH (5 mL), toluene (10 mL) and water (5 mL). The reaction mixture was allowed to stir under a nitrogen atmosphere overnight at room temperature after which time the complete consumption of starting material was observed by TLC (EtOAc) and LC/MS (1.52 min (ES+) m/z (relative intensity) 1171.40 ([M+H]⁺, 100)). The reaction mixture was diluted with EtOAc (400 mL) and washed with H₂O (2×300 mL), brine (200 mL), dried (MgSO₄), filtered and evaporated under reduced pressure to provide the crude product. Purification by flash chromatography (gradient elution: 100:0 v/v EtOAc/MeOH to 85:15 v/v EtOAc/MeOH) afforded the asymmetrical triflate 23 (285 mg, 28%). ¹H NMR (400 MHz, CDCl3) δ 7.39 (s, 1H), 7.37-7.29 (m, 4H), 7.23 (d, J=2.8 Hz, 2H), 7.14 (t, J=2.0 Hz, 1H), 6.89 (d, J=9.0 Hz, 2H), 5.54 (d, J=10.0 Hz, 2H), 4.71 (dd, J=10.0, 2.6 Hz, 2H), 4.62 (td, J=10.7, 3.5 Hz, 2H), 4.13-4.01 (m, 4H), 3.97-3.87 (m, 8H), 3.85-3.75 (m, 2H), 3.74-3.63 (m, 2H), 3.31-3.22 (m, 4H), 3.14 (tdd, J=16.2, 10.8, 2.2 Hz, 2H), 2.73-2.56 (m, 4H), 2.38 (d, J=2.4 Hz, 3H), 2.02-1.92 (m, 4H), 1.73 (dd, J=9.4, 6.0 Hz, 2H), 1.04-0.90 (m, 4H), 0.05--0.00 (m, 18H). MS (ES⁺) m/z (relative intensity) 1171.40 ([M+H]⁺, 100).

(b) (9H-fluoren-9-yl)methyl ((S)-1-(((S)-1-((4-((S)-7-methoxy-8-((5-(((S)-7-methoxy-2-(4-(4-methylpiperazin-1-yl)phenyl)-5,11-dioxo-10-((2-(trimethylsilyl)ethoxy)methyl)-5,10,11,11a-tetrahydro-1H-benzo[e]pyrrolo[1,2-a][1,4]diazepin-8-yl)oxy)pentyl)oxy)-5,11-dioxo-10-((2-(trimethylsilyl)ethoxy)methyl)-5,10,11,11a-tetrahydro-1H-benzo[e]pyrrolo[1,2-a][1,4]diazepin-2-yl)phenyl)amino)-1-oxopropan-2-yl)amino)-3-methyl-1-oxobutan-2-yl)carbamate (24)

Pd(PPh₃)₄ (8 mg, 7 μmol) was added to a stirred mixture of the asymmetrical triflate 23 (269 mg, 0.23 mmol), Fmoc-Val-Ala-4-aminophenylboronic acid, pinacol ester 15 (210 mg, 0.34 mmol), Na₂CO₃ (36.5 mg, 0.34 mmol), EtOH (5 mL), toluene (10 mL), THF (1 mL), and water (5 mL). The reaction mixture was allowed to stir under a nitrogen atmosphere at 35° C. for 2 hours after which time the complete consumption of starting material was observed by TLC (80:20 v/v EtOAc/MeOH) and LC/MS (1.68 min (ES+) m/z (relative intensity) 1508.10 ([M+H]⁺, 100)). The reaction mixture was diluted with EtOAc (100 mL) and washed with H₂O (1×100 mL), brine (200 mL), dried (MgSO₄), filtered and evaporated under reduced pressure to provide the crude product. Purification by flash chromatography (gradient elution: 100:0 v/v EtOAc/MeOH to 80:20 v/v EtOAc/MeOH) afforded the SEM protected dimer 24 (240 mg, 69%). ¹H NMR (400 MHz, CDCl₃) δ 8.42 (s, 1H), 7.76 (d, J=7.5 Hz, 2H), 7.63-7.49 (m, 4H), 7.45-7.28 (m, 9H), 7.25 (d, J=2.9 Hz, 1H), 6.87 (t, J=14.0 Hz, 2H), 6.41 (s, 1H), 5.63-5.49 (m, 2H), 5.25 (s, 1H), 4.71 (d, J=10.1 Hz, 2H), 4.68-4.57 (m, 2H), 4.49 (d, J=6.7 Hz, 2H), 4.20 (s, 1H), 4.16-4.02 (m, 4H), 4.00-3.87 (m, 7H), 3.86-3.61 (m, 7H), 3.30-3.21 (m, 4H), 3.19-3.05 (m, 2H), 2.69-2.54 (m, 4H), 2.37 (s, 3H), 2.04-1.92 (m, 4H), 1.91-1.79 (m, 4H), 1.72 (s, 2H), 1.46 (d, J=6.9 Hz, 3H), 1.04-0.82 (m, 8H), 0.04-0.02 (m, 18H). MS (ES⁺) m/z (relative intensity) 1508.10 ([M+H]⁺, 100).

(c) (9H-fluoren-9-yl)methyl((S)-1-(((S)-1-((4-((S)-7-methoxy-8-((5-(((S)-7-methoxy-2-(4-(4-methylpiperazin-1-yl)phenyl)-5-oxo-5,11a-dihydro-1H-benzo[e]pyrrolo[1,2-a][1,4]diazepin-8-yl)oxy)pentyl)oxy)-5-oxo-5,11a-dihydro-1H-benzo[e]pyrrolo[1,2-a][1,4]diazepin-2-yl)phenyl)amino)-1-oxopropan-2-yl)amino)-3-methyl-1-oxobutan-2-yl)carbamate (25)

Super hydride (0.358 mL, 0.358 mmol, 1.0 M in THF) was added dropwise to a stirred solution of the SEM-tetralactam 24 (216 mg, 0.143 mmol) in anhydrous THF (10 mL) at −78° C. The reaction mixture was allowed to stir for 3 hours after which time the complete conversion of starting material directly was observed by LC/MS (1.37 min (ES+) m/z (relative intensity) 608.15 (([M+2H]²⁺)/2, 100)). The reaction mixture was carefully diluted with H₂O (100 mL) and extracted with DCM (100 mL). The organic layers was washed with brine (100 mL), dried over MgSO₄, filtered and evaporated under reduced pressure to provide the intermediate SEM-carbinolamine. The white solids were immediately dissolved in MeOH (100 mL), DCM (10 mL) and H₂O (20 mL) and treated with flash silica gel (50 g). The thick suspension was allowed to stir at room temperature for 4 days after which time the formation of a significant quantity of desired product was observed by TLC (90:10 v/v CHCl$_3$/MeOH). The reaction mixture was filtered through a porosity 3 sinter funnel and the pad rinsed slowly and thoroughly with 90:10 v/v CHCl$_3$/MeOH until no further product eluted (checked by TLC).

The filtrate was washed with brine (100 mL), dried (MgSO$_4$), filtered and evaporated in vacuo, followed by high vacuum drying, to provide the crude product. Purification by flash chromatography (gradient elution: HPLC grade 98:2 v/v CHCl$_3$/MeOH to 88:12 v/v CHCl$_3$/MeOH) gave 25 as a mixture of carbinolamine ethers and imine (80 mg, 46%).

$^1$H NMR (400 MHz, CDCl3) δ 8.52 (s, 1H), 7.87 (d, J=3.9 Hz, 2H), 7.75 (d, J=7.5 Hz, 2H), 7.66-7.26 (m, 12H), 6.90 (d, J=8.8 Hz, 2H), 6.81 (s, 1H), 6.64 (d, J=6.0 Hz, 1H), 5.37 (d, J=5.7 Hz, 1H), 4.74-4.58 (m, 2H), 4.54-4.31 (m, 4H), 4.26-3.98 (m, 6H), 3.94 (s, 2H), 3.86 (dd, J=13.6, 6.6 Hz, 1H), 3.63-3.48 (m, 2H), 3.37 (dd, J=16.5, 5.6 Hz, 2H), 3.31-3.17 (m, 4H), 2.66-2.51 (m, 4H), 2.36 (s, 3H), 2.16 (d, J=5.1 Hz, 1H), 2.06-1.88 (m, 4H), 1.78-1.55 (m, 6H), 1.46 (d, J=6.8 Hz, 3H), 0.94 (d, J=6.8 Hz, 6H). MS (ES$^+$) m/z (relative intensity) 608.15 (([M+2H]$^{2+}$)/2, 100).

(d) 1-(3-(2,5-dioxo-2,5-dihydro-1H-pyrrol-1-yl)propanamido)-N—((S)-1-(((S)-1-((4-((S)-7-methoxy-8-((5-(((S)-7-methoxy-2-(4-(4-methylpiperazin-1-yl)phenyl)-5-oxo-5,11a-dihydro-1H-benzo[e]pyrrolo[1,2-a][1,4]diazepin-8-yl)oxy)pentyl)oxy)-5-oxo-5,11a-dihydro-1H-benzo[e]pyrrolo[1,2-a][1,4]diazepin-2-yl)phenyl)amino)-1-oxopropan-2-yl)amino)-3-methyl-1-oxobutan-2-yl)-3,6,9,12,15,18,21,24-octaoxaheptacosan-27-amide (26)

Piperidine (0.2 mL) was added to a solution of 25 (77 mg, 63.4 µmol) in DMF (1 mL). The reaction mixture was allowed to stir for 20 minutes. The reaction mixture was carefully diluted with DCM (50 mL) and washed with water (50 mL). The organic layers was washed with brine (100 mL), dried over MgSO$_4$, filtered and evaporated under reduced pressure to provide the unprotected valine intermediate. The crude residue was immediately redissolved in chloroform (5 mL). Mal(Peg)$_8$-acid (56 mg, 95 µmol) and EDCl (18 mg, 95 µmol) were added, followed by methanol (0.1 mL). The reaction was allowed to stir for 3 hours at room temperature at which point completion was observed by TLC and LC/MS (1.19 min (ES+) m/z (relative intensity) 784.25 (([M+2H]$^{2+}$)/2, 100)). The reaction mixture was diluted with chloroform (50 mL), washed with water (100 mL), dried (MgSO$_4$), filtered and evaporated in vacuo, followed by high vacuum drying, to provide the crude product. Purification by flash chromatography (gradient elution: HPLC grade 96:4 v/v CHCl$_3$/MeOH to 90:10 v/v CHCl$_3$/MeOH) gave 26 as a yellow solid (43 mg, 43%). $^1$H NMR (400 MHz, CDCl$_3$) δ8.73 (s, 1H), 7.88 (dd, J=7.6, 3.9 Hz, 2H), 7.75 (d, J=8.6 Hz, 2H), 7.52 (d, J=2.0 Hz, 2H), 7.44 (s, 1H), 7.40-7.28 (m, 4H), 6.91 (d, J=8.8 Hz, 2H), 6.81 (s, 2H), 6.69 (s, 2H), 6.48 (s, 1H), 4.72-4.63 (m, 1H), 4.46-4.34 (m, 2H), 4.25-4.03 (m, 6H), 3.95 (s, 4H), 3.84 (dd, J=17.2, 10.1 Hz, 4H), 3.72-3.46 (m, 30H), 3.44-3.32 (m, 4H), 3.30-3.20 (m, 4H), 2.75-2.63 (m, 1H), 2.59 (s, 4H), 2.55-2.43 (m, 3H), 2.37 (s, 3H), 2.29 (dd, J=12.7, 6.7 Hz, 1H), 2.03-1.89 (m, 4H), 1.72 (d, J=22.7 Hz, 8H), 1.46 (d, J=7.2 Hz, 3H), 1.01 (dd, J=11.5, 6.9 Hz, 6H). MS (ES$^+$) m/z (relative intensity) 784.25 (([M+2H]$^{2+}$)/2, 100).

Example 4

Activity of Released Compounds

K562 Assay

K562 human chronic myeloid leukaemia cells were maintained in RPM1 1640 medium supplemented with 10% fetal calf serum and 2 mM glutamine at 37° C. in a humidified atmosphere containing 5% CO$_2$ and were incubated with a specified dose of drug for 1 hour or 96 hours at 37° C. in the dark. The incubation was terminated by centrifugation (5 min, 300 g) and the cells were washed once with drug-free medium. Following the appropriate drug treatment, the cells were transferred to 96-well microtiter plates (10$^4$ cells per well, 8 wells per sample). Plates were then kept in the dark at 37° C. in a humidified atmosphere containing 5% CO$_2$. The assay is based on the ability of viable cells to reduce a yellow soluble tetrazolium salt, 3-(4,5-dimethylthiazol-2-yl)-2,5-diphenyl-2H-tetrazolium bromide (MTT, Aldrich-Sigma), to an insoluble purple formazan precipitate. Following incubation of the plates for 4 days (to allow control cells to increase in number by approximately 10 fold), 20 µL of MTT solution (5 mg/mL in phosphate-buffered saline) was added to each well and the plates further incubated for 5 h. The plates were then centrifuged for 5 min at 300 g and the bulk of the medium pipetted from the cell pellet leaving 10-20 µL per well. DMSO (200 µL) was added to each well and the samples agitated to ensure complete mixing. The optical density was then read at a wavelength of 550 nm on a Titertek Multiscan ELISA plate reader, and a dose-response curve was constructed. For each curve, an IC$_{50}$ value was read as the dose required to reduce the final optical density to 50% of the control value.

Example 5

Formation of Conjugates

General Antibody Conjugation Procedure

Antibodies are diluted to 1-5 mg/mL in a reduction buffer (examples: phosphate buffered saline PBS, histidine buffer, sodium borate buffer, TRIS buffer). A freshly prepared solution of TCEP (tris(2-carboxyethyl)phosphine hydrochloride) is added to selectively reduce cysteine disulfide bridges. The amount of TCEP is proportional to the target level of reduction, within 1 to 4 molar equivalents per antibody, generating 2 to 8 reactive thiols. After reduction for several hours at 37° C., the mixture is cooled down to room temperature and excess drug-linker added as a diluted DMSO solution (final DMSO content of up to 10% volume/volume of reaction mixture). The mixture was gently shaken at either 4° C. or room temperature for the appropriate time, generally 1-3 hours. Excess reactive thiols can be reacted with a 'thiol capping reagent' like N-ethyl maleimide (NEM) at the end of the conjugation. Antibody-drug conjugates are concentrated using centrifugal spin-filters with a molecular weight cut-off of 10 kDa or higher, then purified by tangential flow filtration (TFF) or Fast Protein Liquid Chromatography (FPLC). Corresponding antibody-drug conjugates can be determined by analysis by High-Performance Liquid Chromatography (HPLC) or Ultra-High-Performance Liquid Chromatography (UHPLC) to assess drug-per-antibody ratio (DAR) using reverse-phase chromatography (RP) or Hydrophobic-Interaction Chromatography (HIC), coupled with UV-Visible, Fluorescence or Mass-Spectrometer detection; aggregate level and monomer purity can be analysed by HPLC or UHPLC using sizeexclusion chromatography coupled with UV-Visible, Fluorescence or Mass-Spectrometer detection. Final conjugate concentration is determined by a combination of spectroscopic (absorbance at 280, 214 and 330 nm) and biochemical assay (bicinchonic acid assay BCA; Smith, P. K., et al. (1985) *Anal. Biochem.* 150 (1): 76-85; using a known-concentration IgG antibody as reference). Antibody-drug conjugates are generally sterile filtered using 0.2 μm filters under aseptic conditions, and stored at +4° C., −20° C. or −80° C.

Formation of Specific Conjugates

ADC1A

Antibody 1 (15 mg, 100.00 nanomoles) was diluted into 12.78 mL of a reduction buffer containing 10 mM sodium borate pH 8.4, 1.0 mM EDTA and a final antibody concentration of 1.11 mg/mL. A 2 mM solution of TCEP was added (2.0 molar equivalent/antibody, 200.00 nanomoles, 99.96 μL) and the reduction mixture was heated at +37° C. for 1.5 hours in an incubator. After cooling down to room temperature, compound A was added as a DMSO solution (10.0 molar equivalent/antibody, 1000 nanomoles, in 1.5 mL DMSO). The solution was mixed for 1.66 hours at room temperature, then the conjugation was quenched by addition of N-acetyl cysteine (400 nanomoles, 400 μL at 10 mM), then injected into an AKTA™ Pure FPLC using a GE Healthcare HiLoad™ 26/600 column packed with Superdex 200 PG, eluting with 2.6 mL/min of sterile-filtered phosphate-buffered saline (PBS). Fractions corresponding to ADC1A-1 monomer peak were pooled, concentrated using a 15 mL Amicon Ultracell 50 KDa MWCO spin filter, analysed and sterile-filtered.

UHPLC analysis on a Shimadzu Prominence system using a Phenomenex Aeris 3.6u XB-C18 150×2.1 mm column eluting with a gradient of water and acetonitrile on a reduced sample of ADC1A-1 at 280 nm and 330 nm (Compound A specific) shows a mixture of light and heavy chains attached to several molecules of compound A, consistent with a drug-per-antibody ratio (DAR) of 2.64 molecules of compound A per antibody.

UHPLC analysis on a Shimadzu Prominence system using a Tosoh Bioscience TSKgel G3000SWXL 5 μm 7.8× 300 mm column (with a 7 μm 6.0×40 mm guard column) eluting with sterile-filtered SEC buffer containing 200 mM potassium phosphate pH 6.95, 250 mM potassium chloride and 10% isopropanol (v/v) on a sample of ADC1A-1 at 280 nm shows a monomer purity of over 94% with no impurity detected. UHPLC SEC analysis gives a concentration of final ADC1A-1 at 1.42 mg/mL in 5.72 mL, obtained mass of ADC1A-1 is 8.12 mg (54% yield).

ADC1B-1

Antibody 1 (3.5 mg, 23.3 nanomoles) was diluted into 3.15 mL of a reduction buffer containing 10 mM sodium borate pH 8.4, 2.5 mM EDTA and a final antibody concentration of 1.11 mg/mL. A 10 mM solution of TCEP was added (1.6 molar equivalent/antibody, 37.3 nanomoles, 3.73 μL) and the reduction mixture was heated at +37° C. for 1.6 hours in an incubator. After cooling down to room temperature, compound B was added as a DMSO solution (7.5 molar equivalent/antibody, 175 nanomoles, in 0.35 mL DMSO). The solution was mixed for 1.6 hours at room temperature, then the conjugation was quenched by addition of N-acetyl cysteine (350 nanomoles, 35 μL at 10 mM), then injected into an AKTA™ Pure FPLC using a GE Healthcare HiLoad™ 26/600 column packed with Superdex 200 PG, eluting with 2.6 mL/min of sterile-filtered phosphate-buffered saline (PBS). Fractions corresponding to ADC1B-1 monomer peak were pooled, concentrated using a 15 mL Amicon Ultracell 50 KDa MWCO spin filter, analysed and sterile-filtered.

UHPLC analysis on a Shimadzu Prominence system using a Phenomenex Aeris 3.6u XB-C18 150×2.1 mm column eluting with a gradient of water and acetonitrile on a reduced sample of ADC1B-1 at 280 nm and 330 nm (Compound B specific) shows a mixture of light and heavy chains attached to several molecules of compound B, consistent with a drug-per-antibody ratio (DAR) of 1.86 molecules of compound B per antibody.

UHPLC analysis on a Shimadzu Prominence system using a Tosoh Bioscience TSKgel G3000SWXL 5 μm 7.8× 300 mm column (with a 7 μm 6.0×40 mm guard column) eluting with sterile-filtered SEC buffer containing 200 mM potassium phosphate pH 6.95, 250 mM potassium chloride and 10% isopropanol (v/v) on a sample of ADC1B-1 at 280 nm shows a monomer purity of over 99% with no impurity detected. UHPLC SEC analysis gives a concentration of final ADC1B-1 at 0.29 mg/mL in 3.5 mL, obtained mass of ADC1B-1 is 1.02 mg (29% yield).

Example 6

In Vitro ADC Efficacy Studies

The cytotoxicity of ADC1A and ADC1B-1 were assessed in a cytoxicity assay against SKBR3 and BT474, as described above, and the results are shown below

| Trastuzumab ADC | EC50 (micrograms/mL) SKBR3 | EC50 (micrograms/mL) BT474 |
| --- | --- | --- |
| ADC1A | 0.003317 | 0.3673 |
| ADC1B-1 | 0.0005719 | 0.02318 |

Theses ADCs were also tested against NCI N87 cells according to the following protocol: Medium from subconfluent (about 80-90% confluency) NCI N87 cells in a T75 flask is aspirated and PBS (about 5 ml) is added to rinse away the culture medium. The PBS is aspirated and Trypsin-EDTA (2 ml) added. The flask is returned to the 37° C. gassed incubator for up to about 5 minutes. The flask is rapped sharply to dislodge and dissociate cells from the plastic. The cell suspension is transferred to a sterile 50 ml screw-top centrifuge tube. Medium (RPMI 1640+10% FCS) is added to a final volume of 10 ml, then the tube is centrifuged (400 g for 5 min). The supernatant is aspirated and the pellet re-suspended in 10 ml culture medium. Repeated aspiration (up and down a 10 ml pipette) may be necessary to break up cell clumps and produce monodisperse cell suspensions suitable for counting. Cell suspension (10 µl) is mixed with Trypan blue (10 µl) and live/dead cells counted with a haemocytometer to determine cell concentration and viability.

The cell suspension is diluted to $20 \times 10^4$/ml and 50 µl is dispensed into clear 96 well flat bottomed plates. The cells are incubated overnight to allow recovery before use.

A stock solution (1 ml) of antibody drug conjugate (ADC) (20 µg/ml) is made by dilution of filter-sterilised ADC into cell culture medium. A set of 8×10-fold dilutions of stock ADC is made in a 24 well plate by serial transfer of 100 µl onto 900 µl of cell culture medium.

50 µl of each ADC dilution is dispensed into 4 replicate wells of the 96-well plate, containing 50 µl cell suspension seeded the previous day. Control wells receive 50 µl cell culture medium.

The 96-well plate containing cells and ADCs is incubated at 37° C. in a $CO_2$-gassed incubator for 7 days.

At the end of the incubation period, viable cells are measured by MTS assay. MTS (Promega) is dispensed (20 µl per well) into each well and incubated for 4 hours at 37° C. in the CO2-gassed incubator. Well absorbance is measured at 490 nm. Percentage cell survival is calculated from the mean absorbance in the 4 ADC-treated wells compared to the mean absorbance in the 4 control wells (100%).

| Trastuzumab ADC | IC50 (micrograms/mL) NCI N87 |
|---|---|
| ADC1A | 0.0009486 |

All documents and other references mentioned above are herein incorporated by reference.

Abbreviations
Ac acetyl
Acm acetamidomethyl
Alloc allyloxycarbonyl
Boc di-tert-butyl dicarbonate
t-Bu tert-butyl
Bzl benzyl, where Bzl-OMe is methoxybenzyl and Bzl-Me is methylbenzene
Cbz or Z benzyloxy-carbonyl, where Z—Cl and Z—Br are chloro- and bromobenzyloxy carbonyl respectively
DMF N,N-dimethylformamide
Dnp dinitrophenyl
DTT dithiothreitol
Fmoc 9H-fluoren-9-yl methoxycarbonyl
imp N-10 imine protecting group: 3-(2-methoxyethoxy)propanoate-Val-Ala-PAB
MC-OSu maleimidocaproyl-O—N-succinimide
Moc methoxycarbonyl
MP maleimidopropanamide
Mtr 4-methoxy-2,3,6-trimethtylbenzenesulfonyl
PAB para-aminobenzyloxycarbonyl
PEG ethyleneoxy
PNZ p-nitrobenzyl carbamate
Psec 2-(phenylsulfonyl)ethoxycarbonyl
TBDMS tert-butyldimethylsilyl
TBDPS tert-butyldiphenylsilyl
Teoc 2-(trimethylsilyl)ethoxycarbonyl
Tos tosyl
Troc 2,2,2-trichlorethoxycarbonyl chloride
Trt trityl
Xan xanthyl

SEQUENCE LISTING (233 sequences)

SEQ ID NO: 1 - protein, 120 aa, Artificial sequence [sequence omitted]

SEQ ID NO: 2 - protein, 107 aa, Artificial sequence [sequence omitted]

SEQ ID NO: 3 - protein, 21 aa, Artificial sequence
  Synthetic sequence: A20FMDV-Cys polypeptide
NAVPNLRGDLQVLAQKVARTC

SEQ ID NO: 4 - protein, 21 aa, Artificial sequence
  Synthetic sequence: A20FMDV-Cys polypeptide
  VARIANT (4)..(18): Xaa is any amino acid residue
NAVXXXXXXXXXXXXXXXRTC

SEQ ID NO: 5 - protein, 137 aa, Artificial sequence
  Synthetic sequence: Anti-Integrin Alpha v Beta 6,  RHAB6.2
QVQLVQSGSELKKPGASVKISCKASGFAFTDSYMHWVRQAPGQGLEWMGWIDPENGDTEYAPKFQGRFVFSLDTSVSTAYLQISSLKAEDTAVYYCTRGTPTAVPNLRGDLQVLAQKVAGPYPFDYWGQGTLVTVSS

SEQ ID NO: 6 - protein, 137 aa, Artificial sequence
  Synthetic sequence: Anti-Integrin Alpha v Beta 6, RHCB6.2
QVQLVQSGAEVKKPGASVKVSCKASGYTFIDSYMHWVRQAPGQRLEWMGWIDPENGDTEYAPKFQGRVTITTDTSASTAYMELSSLRSEDTAVYYCARGTPTAVPNLRGDLQVLAQKVAGPYPFDYWGQGTLVTVSS

SEQ ID NO: 7 - protein, 120 aa, Artificial sequence
  Synthetic sequence: Anti-Integrin Alpha v Beta 6, RHF
QVQLVQSGAEVKKPGASVKVSCKASGFNFIDSYMHWVRQAPGQRLEWMGWIDPENGDTEYAPKFQGRVTFTTDTSASTAYMELSSLRSEDTAVYYCNEGTPTGPYYFDYWGQGTLVTVSS

SEQ ID NO: 8 - protein, 137 aa, Artificial sequence
  Synthetic sequence: Anti-Integrin Alpha v Beta 6, RHFB6
QVQLVQSGAEVKKPGASVKVSCKASGFNFIDSYMHWVRQAPGQRLEWMGWIDPENGDTEYAPKFQGRVTFTTDTSASTAYMELSSLRSEDTAVYYCNEGTPTAVPNLRGDLQVLAQKVAGPYYFDYWGQGTLVTVSS

SEQ ID NO: 9 - protein, 120 aa, Artificial sequence
  Synthetic sequence: Anti-Integrin Alpha v Beta 6, RHAY100bP
QVQLVQSGSELKKPGASVKISCKASGFAFTDSYMHWVRQAPGQGLEWMGWIDPENGDTEYAPKFQGRFVFSLDTSVSTAYLQISSLKAEDTAVYYCTRGTPTGPYPFDYWGQGTLVTVSS

SEQ ID NO: 10 - protein, 106 aa, Artificial sequence
  Synthetic sequence: Anti-Integrin Alpha v Beta 6, RKF
ENVLTQSPGTLSLSPGERATLSCSASSSVSYMHWFQQKPGQAPRLLIYSTSNLASGIPDRFSGSGSGTDFTLTISRLEPEDFAVYYCQQRSSYPLTFGGGTKVEIK

SEQ ID NO: 11 - protein, 106 aa, Artificial sequence
  Synthetic sequence: Anti-Integrin Alpha v Beta 6, RKFL36L50
ENVLTQSPGTLSLSPGERATLSCSASSSVSYMHWLQQKPGQAPRLLIYLTSNLASGIPDRFSGSGSGTDFTLTISRLEPEDFAVYYCQQRSSYPLTFGGGTKVEIK

SEQ ID NO: 12 - protein, 106 aa, Artificial sequence
  Synthetic sequence: Anti-Integrin Alpha v Beta 6, RKC
EIVLTQSPGTLSLSPGERATLSCSASSSVSYMHWFQQKPGQAPRLLIYSTSNLASGIPDRFSGSGSGTDFTLTISRLEPEDFAVYYCQQRSSYPLTFGGGTKVEIK

SEQ ID NO: 13 - protein, 116 aa, Artificial sequence
  Synthetic sequence: Anti-CD33, CD33 Hum195 VH
QVQLVQSGAEVKKPGSSVKVSCKASGYTFTDYNMHWVRQAPGQGLEWIGYIYPYNGGTGYNQKFKSKATITADESTNTAYMELSSLRSEDTAVYYCARGRPAMDYWGQGTLVTVSS

SEQ ID NO: 14 - protein, 111 aa, Artificial sequence
  Synthetic sequence: Anti-CD33, CD33 Hum195 VK
DIQMTQSPSSLSASVGDRVTITCRASESVDNYGISFMNWFQQKPGKAPKLLIYAASNQGSGVPSRFSGSGSGTDFTLTISSLQPDDFATYYCQQSKEVPWTFGQGTKVEIK

SEQ ID NO: 15 - protein, 120 aa, Artificial sequence
  Synthetic sequence: Anti-CD19, CD19 B4 resurfaced VH
QVQLVQPGAEVVKPGASVKLSCKTSGYTFTSNWMHWVKQRPGQGLEWIGEIDPSDSYTNYNQNFKGKAKLTVDKSTSTAYMEVSSLRSDDTAVYYCARGSNPYYYAMDYWGQGTSVTVSS

SEQ ID NO: 16 - protein, 104 aa, Artificial sequence
  Synthetic sequence: Anti-CD19, CD19 B4 resurfaced VK
EIVLTQSPAIMSASPGERVTMTCSASSGVNYMHWYQQKPGTSPRRWIYDTSKLASGVPARFSGSGSGTSYSLTISSMEPEDAATYYCHQRGSYTFGGGTKLEIK

SEQ ID NO: 17 - protein, 104 aa, Artificial sequence [sequence omitted]

SEQ ID NO: 18 - protein, 115 aa, Artificial sequence
  Synthetic sequence: Anti-CD25, Simulect VH
QLQQSGTVLARPGASVKMSCKASGYSFTRYWMHWIKQRPGQGLEWIGAIYPGNSDTSYNQKFEGKAKLTAVTSASTAYMELSSLTHEDSAVYYCSRDYGYYFDFWGQGTTLTVSS

SEQ ID NO: 19 - protein, 115 aa, Artificial sequence
  Synthetic sequence: Anti-PSMA, Deimmunised VH '1
EVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSS

SEQ ID NO: 20 - protein, 107 aa, Artificial sequence
  Synthetic sequence: Anti-PSMA, Deimmunised VK '1
DIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIK

SEQ ID NO: 21 - protein, 116 aa, Artificial sequence
  Synthetic sequence: Anti-PSMA, Deimmunised VH1 '5
EVKLVESGGGLVQPGGSMKLSCVASGFTFSNYWMNWVRQAPGKGLEWVAEIRSQSNNFATHYAESVKGRVTISRDDSKSIVYLQMNNLRAEDTGVYYCTRRWNNFWGQGTTVTVSS

SEQ ID NO: 22 - protein, 116 aa, Artificial sequence
  Synthetic sequence: Anti-PSMA, Deimmunised VH2 '5
EVKLVESGGGLVQPGGSLKLSCVASGFTFSNYWMNWVRQAPGKGLEWVAEIRSQSNNFATHYAESVKGRVTISRDDSKSIVYLQMNNLRAEDTAVYYCTRRWNNFWGQGTTVTVSS

SEQ ID NO: 23 - protein, 116 aa, Artificial sequence
  Synthetic sequence: Anti-PSMA, Deimmunised VH3 '5
EVQLVESGGGLVQPGGSLKLSCVASGFTFSNYWMNWVRQAPGKGLEWVAEIRSQSNNFATHYAESVKGRVTISRDDSKSIVYLQMNNLRAEDTAVYYCTRRWNNFWGQGTTVTVSS

SEQ ID NO: 24 - protein, 116 aa, Artificial sequence
  Synthetic sequence: Anti-PSMA, Deimmunised VH4 '5
EVQLVESGGGLVQPGGSLKLSCVASGFTFSNYWMNWVRQAPGKGLEWVAEIRSQSNNFATHYAESVKGRFTISRDDSKSIVYLQMNNLRAEDTAVYYCTRRWNNFWGQGTTVTVSS

SEQ ID NO: 25 - protein, 107 aa, Artificial sequence
  Synthetic sequence: Anti-PSMA, Deimmunised VK1 '5
NIVMTQFPSSMSASVGDRVTITCKASENVGTYVSWYQQKPDQSPKMLIYGASNRFTGVPDRFTGSGSATDFTLTISSLQTEDLADYYCGQSYTFPYTFGQGTKLEMK

SEQ ID NO: 26 - protein, 107 aa, Artificial sequence
  Synthetic sequence: Anti-PSMA, Deimmunised VK2 '5
NIVMTQFPSSMSASVGDRVTITCKASENVGTYVSWYQQKPDQSPKMLIYGASNRFTGVPDRFSGSGSGTDFTLTISSLQAEDLADYYCGQSYTFPYTFGQGTKLEIK

SEQ ID NO: 27 - protein, 107 aa, Artificial sequence
  Synthetic sequence: Anti-PSMA, Deimmunised VK3 '5
NIQMTQFPSAMSASVGDRVTITCKASENVGTYVSWYQQKPDQSPKMLIYGASNRFTGVPDRFSGSGSGTDFTLTISSLQAEDLADYYCGQSYTFPYTFGQGTKLEIK

SEQ ID NO: 28 - protein, 107 aa, Artificial sequence
  Synthetic sequence: Anti-PSMA, Deimmunised VK4 '5
NIQMTQFPSAMSASVGDRVTITCKASENVGTYVSWYQQKPDQSPKMLIYGASNRFTGVPDRFSGSGSGTDFTLTISSLQAEDEADYYCGQSYTFPYTFGQGTKLEIK

SEQ ID NO: 29 - protein, 107 aa, Artificial sequence
  Synthetic sequence: Anti-PSMA, Deimmunised VK DI '5
NIVMTQFPKSMSASAGERMTLTCKASENVGTYVSWYQQKPTQSPKMLIYGASNRFTGVPDRFSGSGSGTDFILTISSVQAEDLVDYYCGQSYTFPYTFGGGTKLEMK

SEQ ID NO: 30 - protein, 116 aa, Artificial sequence
  Synthetic sequence: Anti-PSMA, Deimmunised VH DI '5
EVKLEESGGGLVQPGGSMKISCVASGFTFSNYWMNWVRQSPEKGLEWVAEIRSQSNNFATHYAESVKGRVIISRDDSKSSVYLQMNSLRAEDTAVYYCTRRWNNFWGQGTTVTVSS

SEQ ID NO: 31 - protein, 116 aa, Artificial sequence
  Synthetic sequence: Anti-PSMA, Humanised RHA '5
EVQLVESGGGLVQPGGSLKLSCAASGFTFSNYWMNWVRQASGKGLEWVGEIRSQSNNFATHYAESVKGRFTISRDDSKNTAYLQMNSLKTEDTAVYYCTRRWNNFWGQGTTVTVSS

SEQ ID NO: 32 - protein, 116 aa, Artificial sequence
  Synthetic sequence: Anti-PSMA, Humanised RHB '5
EVKLVESGGGLVQPGGSLKLSCAASGFTFSNYWMNWVRQASGKGLEWVAEIRSQSNNFATHYAESVKGRVIISRDDSKNTVYLQMNSLRTEDTAVYYCTRRWNNFWGQGTTVTVSS

SEQ ID NO: 33 - protein, 116 aa, Artificial sequence
  Synthetic sequence: Anti-PSMA, Humanised RHC '5
EVQLVESGGGLVQPGGSLKLSCAASGFTFSNYWMNWVRQASGKGLEWVAEIRSQSNNFATHYAESVKGRVIISRDDSKNTVYLQMNSLRTEDTAVYYCTRRWNNFWGQGTTVTVSS

SEQ ID NO: 34 - protein, 116 aa, Artificial sequence
  Synthetic sequence: Anti-PSMA, Humanised RHD '5
EVKLVESGGGLVQPGGSLKLSCAASGFTFSNYWMNWVRQASGKGLEWVGEIRSQSNNFATHYAESVKGRVIISRDDSKNTVYLQMNSLRTEDTAVYYCTRRWNNFWGQGTTVTVSS

SEQ ID NO: 35 - protein, 116 aa, Artificial sequence
  Synthetic sequence: Anti-PSMA, Humanised RHE '5
EVKLVESGGGLVQPGGSLKLSCAASGFTFSNYWMNWVRQASGKGLEWVAEIRSQSNNFATHYAESVKGRFTISRDDSKNTVYLQMNSLRTEDTAVYYCTRRWNNFWGQGTTVTVSS

SEQ ID NO: 36 - protein, 116 aa, Artificial sequence
  Synthetic sequence: Anti-PSMA, Humanised RHF '5
EVKLVESGGGLVQPGGSLKLSCAASGFTFSNYWMNWVRQASGKGLEWVAEIRSQSNNFATHYAESVKGRVIISRDDSKNTAYLQMNSLRTEDTAVYYCTRRWNNFWGQGTTVTVSS

SEQ ID NO: 37 - protein, 116 aa, Artificial sequence; identical to SEQ ID NO: 36
  Synthetic sequence: Anti-PSMA, Humanised RHG '5

SEQ ID NO: 38 - protein, 107 aa, Artificial sequence
  Synthetic sequence: Anti-PSMA, Humanised RKA '5
DIQMTQSPSSVSASVGDRVTITCKASENVGTYVSWYQQKPGTAPKLLIYGASNRFTGVPSRFSGSGSATDFTLTINNLQPEDFATYYCGQSYTFPYTFGQGTKVEIK

SEQ ID NO: 39 - protein, 107 aa, Artificial sequence; identical to SEQ ID NO: 38
  Synthetic sequence: Anti-PSMA, Humanised RKB '5

SEQ ID NO: 40 - protein, 107 aa, Artificial sequence
  Synthetic sequence: Anti-PSMA, Humanised RKC '5
DIQMTQSPSSVSASVGDRVTITCKASENVGTYVSWYQQKPGTAPKMLIYGASNRFTGVPSRFSGSGSATDFTLTINNLQPEDFATYYCGQSYTFPYTFGQGTKVEIK

SEQ ID NO: 41 - protein, 107 aa, Artificial sequence; identical to SEQ ID NO: 40
  Synthetic sequence: Anti-PSMA, Humanised RKD '5

SEQ ID NO: 42 - protein, 107 aa, Artificial sequence
  Synthetic sequence: Anti-PSMA, Humanised RKE '5
NIVMTQSPSSVSASVGDRVTITCKASENVGTYVSWYQQKPGTAPKLLIYGASNRFTGVPDRFTGSGSATDFILTINNLQPEDFATYYCGQSYTFPYTFGQGTKVEIK

SEQ ID NO: 43 - protein, 107 aa, Artificial sequence
  Synthetic sequence: Anti-PSMA, Humanised RKF '5
NIVMTQSPSSVSASVGDRVTITCKASENVGTYVSWYQQKPGTAPKMLIYGASNRFTGVPSRFSGSGSATDFILTINNLQPEDFATYYCGQSYTFPYTFGQGTKVEIK

SEQ ID NO: 44 - protein, 107 aa, Artificial sequence
  Synthetic sequence: Anti-PSMA, Humanised RKG '5
NIVMTQSPSSVSASVGDRVTITCKASENVGTYVSWYQQKPGTAPKMLIYGASNRFTGVPDRFTGSGSATDFTLTINNLQPEDFATYYCGQSYTFPYTFGQGTKVEIK

SEQ ID NO: 45 - DNA, 5560 bp, Homo sapiens
cgcggggcgcggagtcggcggggcctcgcgggacgccgggcagtgcggagaccgcggcgctgaggacgcgggagccgggagcgcagccgcggggtggagttcagcctactctttcttagatgtgaaaggaaaggaagatcatttcatgccttgttgataaaggttcagacttctgctgattcataaccatttggctctgagctatgacaagagaggaaacaaaaagttaaacaagcaagcctgccataagtgagaagcaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctgataggagaggaaaagtaagcatctctgcagaaagccaacaggtactcttctgtttgtgggcagagcaaaagacatcaaataagcatccacagtacaagccttgaacatcgtcctgcttcccagtgggttcagacctcacctctcagggagcgacctgggcaaagacagagaagctcccagaaggagagattgatccatgtctgtttgtaggacggagaaaccgcttgggtaacttgttcaagatatgatgcatgttgctttctaagaaagccctgtattttgtgattgcctttttttttttttaagatgctttcattttgccaaaataaaacagataatgtggatggtttaagggttatagtattatagtttaaataataacaacaaaattcttcccaggaactctgctggaaggtaaattaaaatacttgtttttccattggtaaaatattgttgcactctgtgaaccaaaagacagtctaagttggaggacatagaacggaactcatcttaaacatactccccaccccgtcttggcctcctcagaccactttggccatccctgcatttggggccgctatggtaatgtgaatgcactgggtacaaacaccgcctgtctaggaccacatttggaattcctgcaggtggccttttgcagcttcaggcaatatggaacaaatgaaggtttatgtgactctaatagaagtaattgttgataggtgttcttcagatccacttctgtttctgattgagttaggcatctctttcatggtaaaacccttttcattaaacacaaagaaagcttttttttttttttttttttttttttttttttaatgtgcagaggattgacctgtgcatgcttttgatctctcattcaaaggatcaatattaaataaaattgtcatgagctgtgttgaagacagggtgctttcaaatagaggtaatttgctcttgtgttgtaagaggaacatgtcaacaaagataggaaatgagggtgatcgtgcagatggcttgtatcttatatatgcaaaggagccaatctcagaagcacaaagaaaaaagtgtgcataccttattttgtacagataaagatgatgtctttttgttattgtctgtctgttttgtatgtgtctgagataagggatagagaggaaacatccgtcaggctaatttaactacattttattttaaaaatagagaaacataacctctagatgggacagcagaggacagttagtagaggccacaaactgttatgggctgctgtgttttgttctaaaatcaatatggttggagcatgtatatcttaggtgatcatttcacatcttaggaatgcctactcattttattttattctagtgatgctcaattcactatttaatttattatattttctcttctgtggcacttatacaaaatatctcttcacctacttagttctacagggttttaactttggagcaacatgaataaaatcatcgagaaggccaatattgtttagcaacatgaatacaatacagtttaaagttgtacacatcctgctcaactttattcatatacatttcctttctgtggttttcttttgcttcttagaaattctgttagtggttagtaaagaatttgaaagtactttctccttgctgtttttttttttttttaagacattcctcccagaatactccagggggcagtgttttataacacattttccccactgggtgattgaaggatggaggatttttgaaaatttgacagctacatgaaacatgagaaaacattttcctcacttctgaagtcggtttgcagctggtaacttgttcatccagaaaacattctaaagcaatgagactttgtgagctgtgcttacagtttgggagaatcatgaagattctttctatattttgcatttacttcccagtgcttcatagctgcattttgtttgtaactaagacagaagaatttcgtaatccttgaaattgaaaaaaaaaaaattgtgtttttaaagagtgaaaacagttagaaaacaagtagaactgtaatcagaacgctgcttcaattgatattaaaaataacctcaataataatgtaaaggttcctttctcttgtgtcagttatattcttagggatagcctagaaggaatatatggttagaactaagtgtgactaatcatctgagccttgaagagaaacttcagtgcctctaaacagatcatctacaaaacaacaggtaaacatttatgccagttaagtgggtcatgtttttgtttcttgggtttttcctaaatttaagtgaggttgggcttaccttgtagataaaattatgttttctttttggtaaatacttgaacgtggataacgtcaaatcagaatattttgtgaggaggtgatgatttgaaattaagctagatttctagggaggtgttggttccaatgaaggatgggaagaaattaaaatagtcttcaaacttcttccttattatatttggttgctttggaaaagattggtcctatcctcaatctaatttattcactattaatattttaaaaacattcctgagatacttaaaaagacccacttagcgattatagttgctcaatgaaacaagaatttatttatgcatagatttttctctgtatcttaccaaaatccactttacttagataacactaaattgttcttaaagactactcatttcccaataatcctttatgatttcaaaatttctagtggctcagaagtgaattttattttatttgtctttcacttgaataaatgagaacccagaaattaataatgttgtttattgcttactgtcaggactatttcaaagactaagaagagtttcttctaacccctccctctcaaaggaatcctaaattattagttgttagataagttttgtatgctaagatattcaggtttatagtttatgtatgtgtgtatatatataaatatatatgtatatataaatattatgttcagtttggagtctggcacaactccattatgtggattagagagtaagatattatggatgataaagtactaaatgaaacataatatttatttataaaagtgtgtagattgttaaatcacaaaaagagtgctatgaccattatgtatgaggaaacaggcctttgacctcctggaaagcactgctcaaaagtcattagtgcccatttttgaattccccaaacagaaagcttcttagaaaacatgctgagattttatttacagggaattctttgacacatttcaattggtgtgtagtcaagtatagcaagtacttaataatgactgaatttcatgttcctacagtcatacatattcattagaagttttatgttgttggtctgatctgattcttctttgtttgtgggtggaacggcactgagagaagtatagttttttaaacttgaacatgttcagtagttacattgccttagaaaacccagacacatagcagtggaaatgaaagaaatggcatcagaagtgacttaatttagcaattgtgattcctcttgtaaaacaaaacaaaaaaacaatgccatattttttggagaaaagttggcaatataggggtttcgttgtctgtttcacaagaagactcatttgttcttttgggggaaccagtgccttacagattttgtatatactgtaattattcaggactagggaacaaacaattgtattgtatttgttacagattgtatatggctttgttttaacattcccctaaataaaatggcttcattctccccttggaaaaaaaca

SEQ ID NO: 46 - protein, 502 aa, Homo sapiens
MLLRSAGKLNVGTKKEDGESTAPTPRPKVLRCKCHHHCPEDSVNNICSTDGYCFTMIEEDDSGLPVVTSGCLGLEGSDFQCRDTPIPHQRRSIECCTERNECNKDLHPTLPPLKNRDFVDGPIHHRALLISVTVCSLLLVLIILFCYFRYKRQETRPRYSIGLEQDETYIPPGESLRDLIEQSQSSGSGSGLPLLVQRTIAKQIQMVKQIGKGRYGEVWMGKWRGEKVAVKVFFTTEEASWFRETEIYQTVLMRHENILGFIAADIKGTGSWTQLYLITDYHENGSLYDYLKSTTLDAKSMLKLAYSSVSGLCHLHTEIFSTQGKPAIAHRDLKSKNILVKKNGTCCIADLGLAVKFISDTNEVDIPPNTRVGTKRYMPPEVLDESLNRNHFQSYIMADMYSFGLILWEVARRCVSGGIVEEYQLPYHDLVPSDPSYEDMREIVCIKKLRPSFPNRWSSDECLRQMGKLMTECWAHNPASRLTALRVKKTLAKMSESQDIKL

SEQ ID NO: 47 - DNA, 4543 bp, Homo sapiens
cggcgggcggcgcgcacactgctcgctgggccgcggctcccgggtgtcccaggcccggccggtgcgcagagcatggcgggtgcgggcccgaagcggcgcgcgctagcggcgccggcggccgaggagaaggaagaggcgcgggagaagatgctggccgccaagagcgcggacggctcggcgccggcaggcgagggcgagggcgtgaccctgcagcggaacatcacgctgctcaacggcgtggccatcatcgtggggaccattatcggctcgggcatcttcgtgacgcccacgggcgtgctcaaggaggcaggctcgccggggctggcgctggtggtgtgggccgcgtgcggcgtcttctccatcgtgggcgcgctctgctacgcggagctcggcaccaccatctccaaatcgggcggcgactacgcctacatgctggaggtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtggcctgcctctgcgtgctgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagaccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatccta

SEQ ID NO: 48 - protein, 507 aa, Homo sapiens
MAGAGPKRRALAAPAAEEKEEAREKMLAAKSADGSAPAGEGEGVTLQRNITLLNGVAIIVGTIIGSGIFVTPTGVLKEAGSPGLALVVWAACGVFSIVGALCYAELGTTISKSGGDYAYMLEVYGSLPAFLKLWIELLIIRPSSQYIVALVFATYLLKPLFPTCPVPEEAAKLVACLCVLLLTAVNCYSVKAATRVQDAFAAAKLLALALIILLGFVQIGKGDVSNLDPNFSFEGTKLDVGNIVLALYSGLFAYGGWNYLNFVTEEMINPYRNLPLAIIISLPIVTLVYVLTNLAYFTTLSTEQMLSSEAVAVDFGNYHLGVMSWIIPVFVGLSCFGSVNGSLFTSSRLFFVGSREGHLPSILSMIHPQLLTPVPSLVFTCVMTLLYAFSKDIFSVINFFSFFNWLCVALAIIGMIWLRHRKPELERPIKVNLALPVFFILACLFLIAVSFWKTPVECGIGFTIILSGLPVYFFGVWWKNKPKWLLQGIFSTTVLCQKLMQVVPQET

SEQ ID NO: 49 - DNA, 1330 bp, Homo sapiens
gcggacgcggggcgccagcaggtggcgctggacgcgcaacggacaaggaggcggggcctgcagctggcttggaggctccgcgctctggaggctcaggcgccgcgtggggcccgcacctctgggcagcagcggcagccgagactcacggtcaagctaaggcgaagagtgggtggctgaagccatactattttatagaattaatggaaagcagaaaagacatcacaaaccaagaagaactttggaaaatgaagcctaggagaaatttagaagaagacgattatttgcataaggacacgggagagaccagcatgctaaaaagacctgtgcttttgcatttgcaccaaacagcccatgctgatgaatttgactgcccttcagaacttcagcacacacaggaactctttccacagtggcacttgccaattaaaatagctgctattatagcatctctgacttttctttacactcttctgagggaagtaattcaccctttagcaacttcccatcaacaatatttttataaaattccaatcctggtcatcaacaaagtcttgccaatggtttccatcactctcttggcattggtttacctgccaggtgtgatagcagcaattgtccaacttcataatggaaccaagtataagaagtttccacattggttggataagtggatgttaacaagaaagcagtttgggcttctcagtttcttttttgctgtactgcatgcaatttatagtctgtcttacccaatgaggcgatcctacagatacaagttgctaaactgggcatatcaacaggtccaacaaaataaagaagatgcctggattgagcatgatgtttggagaatggagatttatgtgtctctgggaattgtgggattggcaatactggctctgttggctgtgacatctattccatctgtgagtgactctttgacatggagagaatttcactatattcagagcaagctaggaattgtttcccttctactgggcacaatacacgcattgatttttgcctggaataagtggatagatataaaacaatttgtatggtatacacctccaacttttatgatagctgttttccttccaattgttgtcctgatatttaaaagcatactattcctgccatgcttgaggaagaagatactgaagattagacatggttgggaagacgtcaccaaaattaacaaaactgagatatgttcccagttgtagaattactgtttacacacatttttgttcaatattgatatattttatcaccaacatttcaagtttgtatttgttaataaaatgattattcaaggaaaaaaaaaaaaaaaaaa

SEQ ID NO: 50 - protein, 339 aa, Homo sapiens
MESRKDITNQEELWKMKPRRNLEEDDYLHKDTGETSMLKRPVLLHLHQTAHADEFDCPSELQHTQELFPQWHLPIKIAAIIASLTFLYTLLREVIHPLATSHQQYFYKIPILVINKVLPMVSITLLALVYLPGVIAAIVQLHNGTKYKKFPHWLDKWMLTRKQFGLLSFFFAVLHAIYSLSYPMRRSYRYKLLNWAYQQVQQNKEDAWIEHDVWRMEIYVSLGIVGLAILALLAVTSIPSVSDSLTWREFHYIQSKLGIVSLLLGTIHALIFAWNKWIDIKQFVWYTPPTFMIAVFLPIVVLIFKSILFLPCLRKKILKIRHGWEDVTKINKTEICSQL

SEQ ID NO: 51 - DNA, 21112 bp, Homo sapiens
cctgtgacttctcttctcacccctggcctggtgataaccacagacaggatgggcataagcagagaacctggaaccagttccacttcaaatttgagcagcacctcccatgagagactgaccactttggaagacactgtagatacagaagccatgcagccttccacacacacagcagtgaccaacgtgaggacctccatttctggacatgaatcacaatcttctgtcctatctgactcagagacacccaaagccacatctccaatgggtaccacctacaccatgggggaaacgagtgtttccatatccacttctgacttctttgagaccagcagaattcagatagaaccaacatcctccctgacttctggattgagggagaccagcagctctgagaggatcagctcagccacagagggaagcactgtcctttctgaagtgcccagtggtgctaccactgaggtctccaggacagaagtgatatcctctaggggaacatccatgtcagggcctgatcagttcaccatatcaccagacatctctactgaagcgatcaccaggctttctacttcccccattatgacagaatcagcagaaagtgccatcactattgagacaggttctcctggggctacatcagagggtaccctcaccttggacacctcaacaacaaccttttggtcagggacccactcaactgcatctccaggattttcacactcagagatgaccactcttatgagtagaactcctggagatgtgccatggccgagccttccctctgtggaagaagccagctctgtctcttcctcactgtcttcacctgccatgacctcaacttcttttttctccacattaccagagagcatctcctcctctcctcatcctgtgactgcacttctcacccttggcccagtgaagaccacagacatgttgcgcacaagctcagaacctgaaaccagttcacctccaaatttgagcagcacctcagctgaaatattagccacgtctgaagtcaccaaagatagagagaaaattcatccctcctcaaacacacctgtagtcaatgtagggactgtgatttataaacatctatccccttcctctgttttggctgacttagtgacaacaaaacccacatctccaatggctaccacctccactctggggaatacaagtgtttccacatcaactcctgccttcccagaaactatgatgacacagccaacttcctccctgacttctggattaagggagatcagtacctctcaagagaccagctcagcaacagagagaagtgcttctctttctggaatgcccactggtgctactactaaggtctccagaacagaagccctctccttaggcagaacatccaccccaggtcctgctcaatccacaatatcaccagaaatctccacggaaaccatcactagaatttctactcccctcaccacgacaggatcagcagaaatgaccatcacccccaaaacaggtcattctggggcatcctcacaaggtacctttaccttggacacatcaagcagagcctcctggccaggaactcactcagctgcaactcacagatctccacactcagggatgaccactcctatgagcagaggtcctgaggatgtgtcatggccaagccgcccatcagtggaaaaaactagccctccatcttccctggtgtctttatctgcagtaacctcaccttcgccactttattccacaccatctgagagtagccactcgtctcctctccgggtgacttctcttttcacccctgtcatgatgaagaccacagacatgttggacacaagcttggaacctgtgaccacttcacctcccagtatgaatatcacctcagatgagagtctggccacttctaaagccaccatggagacagaggcaattcagctttcagaaaacacagctgtgactcagatgggcaccatcagtgctagacaagaattctattcctcttatccaggcctcccagagccatccaaagtgacatctccagtggtcacctcttccaccataaaagacattgtttctacaaccatacctgcttcctctgagataacaagaattgagatggagtcaacatccaccctgacccccacaccaagggagaccagcacctcccaggagatccactcagccacaaagccaagcactgttccttacaaggcactcactagtgccacgattgaggactccatgacacaagtcatgtcctctagcagaggacctagccctgatcagtccacaatgtcacaagacatatccactgaagtgatcaccaggctctctacctcccccatcaagacagaatctacagaaatgaccattaccacccaaacaggttctcctggggctacatcaaggggtacccttaccttggacacttcaacaacttttatgtcagggacccattcaactgcatctcaaggattttcacactcacagatgaccgctcttatgagtagaactcctggagaggtgccatggctaagccatccctctgtggaagaagccagctctgcctctttctcactgtcttcacctgtcatgacctcatcttctcccgtttcttccacattaccagacagcatccactcttcttcgcttcctgtgacatcacttctcacctcagggctggtgaagaccacagagctgttgggcacaagctcagaacctgaaaccagttcacccccaaatttgagcagcacctcagctgaaatactggccaccactgaagtcactacagatacagagaaactggagatgaccaatgtggtaacctcaggttatacacatgaatctccttcctctgtcctagctgactcagtgacaacaaaggccacatcttcaatgggtatcacctaccccacaggagatacaaatgttctcacatcaacccctgccttctctgacaccagtaggattcaaacaaagtcaaagctctcactgactcctgggttgatggagaccagcatctctgaagagaccagctctgccacagaaaaaagcactgtcctttctagtgtgcccactggtgctactactgaggtctccaggacagaagccatctcttctagcagaacatccatcccaggccctgctcaatccacaatgtcatcagacacctccatggaaaccatcactagaatttctacccccctcacaaggaaagaatcaacagacatggccatcacccccaaaacaggtccttctggggctacctcgcagggtacctttaccttggactcatcaagcacagcctcctggccaggaactcactcagctacaactcagagatttccacggtcagtggtgacaactcctatgagcagaggtcctgaggatgtgtcatggccaagcccgctgtctgtggaaaaaaacagccctccatcttccctggtatcttcatcttcagtaacctcaccttcgccactttattccacaccatctgggagtagccactcctctcctgtccctgtcacttctcttttcacctctatcatgatgaaggccacagacatgttggatgcaagtttggaacctgagaccacttcagctcccaatatgaatatcacctcagatgagagtctggccgcttctaaagccaccacggagacagaggcaattcacgtttttgaaaatacagcagcgtcccatgtggaaaccaccagtgctacagaggaactctattcctcttccccaggcttctcagagccaacaaaagtgatatctccagtggtcacctcttcctctataagagacaacatggtttccacaacaatgcctggctcctctggcattacaaggattgagatagagtcaatgtcatctctgacccctggactgagggagaccagaacctcccaggacatcacctcatccacagagacaagcactgtcctttacaagatgccctctggtgccactcctgaggtctccaggacagaagttatgccctctagcagaacatccattcctggccctgctcagtccacaatgtcactagacatctccgatgaagttgtcaccaggctgtctacctctcccatcatgacagaatctgcagaaataaccatcaccacccaaacaggttattctctggctacatcccaggttacccttcccttgggcacctcaatgacctttttgtcagggacccactcaactatgtctcaaggactttcacactcagagatgaccaatcttatgagcaggggtcctgaaagtctgtcatggacgagccctcgctttgtggaaacaactagatcttcctcttctctgacatcattacctctcacgacctcactttctcctgtgtcctccacattactagacagtagcccctcctctcctcttcctgtgacttcacttatcctcccaggcctggtgaagactacagaagtgttggatacaagctcagagcctaaaaccagttcatctccaaatttgagcagcacctcagttgaaataccggccacctctgaaatcatgacagatacagagaaaattcatccttcctcaaacacagcggtggccaaagtgaggacctccagttctgttcatgaatctcattcctctgtcctagctgactcagaaacaaccataaccataccttcaatgggtatcacctccgctgtggaggataccactgttttcacatcaaatcctgccttctctgagactaggaggattccgacagagccaacattctcattgactcctggattcagggagactagcacctctgaagagaccacctcaatcacagaaacaagtgcagtcctttttggagtgcccactagtgctactactgaagtctccatgacagaaataatgtcctctaatagaacacacatccctgactctgatcagtccacgatgtctccagacatcatcactgaagtgatcaccaggctctcttcctcatccatgatgtcagaatcaacacaaatgaccatcaccacccaaaaaagttctcctggggctacagcacagagtactcttaccttggccacaacaacagcccccttggcaaggacccactcaactgttcctcctagatttttacactcagagatgacaactcttatgagtaggagtcctgaaaatccatcatggaagagctctccctttgtggaaaaaactagctcttcatcttctctgttgtccttacctgtcacgacctcaccttctgtttcttccacattaccgcagagtatcccttcctcctctttttctgtgacttcactcctcaccccaggcatggtgaagactacagacacaagcacagaacctggaaccagtttatctccaaatctgagtggcacctcagttgaaatactggctgcctctgaagtcaccacagatacagagaaaattcatccttcttcaagcatggcagtgaccaatgtgggaaccaccagttctggacatgaactatattcctctgtttcaatccactcggagccatccaaggctacatacccagtgggtactccctcttccatggctgaaacctctatttccacatcaatgcctgctaattttgagaccacaggatttgaggctgagccattttctcatttgacttctggacttaggaagaccaacatgtccctggacaccagctcagtcacaccaacaaatacaccttcttctcctgggtccactcaccttttacagagttccaagactgatttcacctcttctgcaaaaacatcatccccagactggcctccagcctcacagtatactgaaattccagtggacataatcaccccctttaatgcttctccatctattacggagtccactgggataacctccttcccagaatccaggtttactatgtctgtaacagaaagtactcatcatctgagtacagatttgctgccttcagctgagactatttccactggcacagtgatgccttctctatcagaggccatgacttcatttgccaccactggagttccacgagccatctcaggttcaggtagtccattctctaggacagagtcaggccctggggatgctactctgtccaccattgcagagagcctgccttcatccactcctgtgccattctcctcttcaaccttcactaccactgattcttcaaccatcccagccctccatgagataacttcctcttcagctaccccatatagagtggacaccagtcttgggacagagagcagcactactgaaggacgcttggttatggtcagtactttggacacttcaagccaaccaggcaggacatcttcatcacccattttggataccagaatgacagagagcgttgagctgggaacagtgacaagtgcttatcaagttccttcactctcaacacggttgacaagaactgatggcattatggaacacatcacaaaaatacccaatgaagcagcacacagaggtaccataagaccagtcaaaggccctcagacatccacttcgcctgccagtcctaaaggactacacacaggagggacaaaaagaatggagaccaccaccacagctctgaagaccaccaccacagctctgaagaccacttccagagccaccttgaccaccagtgtctatactcccactttgggaacactgactcccctcaatgcatcaatgcaaatggccagcacaatccccacagaaatgatgatcacaaccccatatgttttccctgatgttccagaaacgacatcctcattggctaccagcctgggagcagaaaccagcacagctcttcccaggacaaccccatctgttttcaatagagaatcagagaccacagcctcactggtctctcgttctggggcagagagaagtccggttattcaaactctagatgtttcttctagtgagccagatacaacagcttcatgggttatccatcctgcagagaccatcccaactgtttccaagacaacccccaattttttccacagtgaattagacactgtatcttccacagccaccagtcatggggcagacgtcagctcagccattccaacaaatatctcacctagtgaactagatgcactgaccccactggtcactatttcggggacagatactagtacaacattcccaacactgactaagtccccacatgaaacagagacaagaaccacatggctcactcatcctgcagagaccagctcaactattcccagaacaatccccaatttttctcatcatgaatcagatgccacaccttcaatagccaccagtcctggggcagaaaccagttcagctattccaattatgactgtctcacctggtgcagaagatctggtgacctcacaggtcactagttctggcacagacagaaatatgactattccaactttgactctttctcctggtgaaccaaagaccatagcctcattagtcacccatcctgaagcacagacaagttcggccattccaacttcaactatctcgcctgctgtatcacggttggtgacctcaatggtcaccagtttggcggcaaagacaagtacaactaatcgagctctgacaaactcccctggtgaaccagctacaacagtttcattggtcacgcattctgcacagaccagcccaacagttccctggacaacttccatttttttccatagtaaatcagacaccacaccttcaatgaccaccagtcatggggcagaatccagttcagctgttccaactccaactgtttcaactgaggtaccaggagtagtgacccctttggtcaccagttctagggcagtgatcagtacaactattccaattctgactctttctcctggtgaaccagagaccacaccttcaatggccaccagtcatggggaagaagccagttctgctattccaactccaactgtttcacctggggtaccaggagtggtgacctctctggtcactagttctagggcagtgactagtacaactattccaattctgactttttctcttggtgaaccagagaccacaccttcaatggccaccagtcatgggacagaagctggctcagctgttccaactgttttacctgaggtaccaggaatggtgacctctctggttgctagttctagggcagtaaccagtacaactcttccaactctgactctttctcctggtgaaccagagaccacaccttcaatggccaccagtcatggggcagaagccagctcaactgttccaactgtttcacctgaggtaccaggagtggtgacctctctggtcactagttctagtggagtaaacagtacaagtattccaactctgattctttctcctggtgaactagaaaccacaccttcaatggccaccagtcatggggcagaagccagctcagctgttccaactccaactgtttcacctggggtatcaggagtggtgacccctctggtcactagttccagggcagtgaccagtacaactattccaattctaactctttcttctagtgagccagagaccacaccttcaatggccaccagtcatggggtagaagccagctcagctgttctaactgtttcacctgaggtaccaggaatggtgacctttctggtcactagttctagagcagtaaccagtacaactattccaactctgactatttcttctgatgaaccagagaccacaacttcattggtcacccattctgaggcaaagatgatttcagccattccaactttaggtgtctcccctactgtacaagggctggtgacttcactggtcactagttctgggtcagagaccagtgcgttttcaaatctaactgttgcctcaagtcaaccagagaccatagactcatgggtcgctcatcctgggacagaagcaagttctgttgttccaactttgactgtctccactggtgagccgtttacaaatatctcattggtcacccatcctgcagagagtagctcaactcttcccaggacaacctcaaggttttcccacagtgaattagacactatgccttctacagtcaccagtcctgaggcagaatccagctcagccatttcaacaactatttcacctggtataccaggtgtgctgacatcactggtcactagctctgggagagacatcagtgcaacttttccaacagtgcctgagtccccacatgaatcagaggcaacagcctcatgggttactcatcctgcagtcaccagcacaacagttcccaggacaacccctaattattctcatagtgaaccagacaccacaccatcaatagccaccagtcctggggcagaagccacttcagattttccaacaataactgtctcacctgatgtaccagatatggtaacctcacaggtcactagttctgggacagacaccagtataactattccaactctgactctttcttctggtgagccagagaccacaacctcatttatcacctattctgagacacatacaagttcagccattccaactctccctgtctcccctgatgcatcaaagatgctgacctcactggtcatcagttctgggacagacagcactacaactttcccaacactgacggagaccccatatgaaccagagacaacagccatacagctcattcatcctgcagagaccaacacaatggttcccaggacaactcccaagttttcccatagtaagtcagacaccacactcccagtagccatcaccagtcctgggccagaagccagttcagctgtttcaacgacaactatctcacctgatatgtcagatctggtgacctcactggtccctagttctgggacagacaccagtacaaccttcccaacattgagtgagaccccatatgaaccagagactacagccacgtggctcactcatcctgcagaaaccagcacaacggtttctgggacaattcccaacttttcccataggggatcagacactgcaccctcaatggtcaccagtcctggagtagacacgaggtcaggtgttccaactacaaccatcccacccagtataccaggggtagtgacctcacaggtcactagttctgcaacagacactagtacagctattccaactttgactccttctcctggtgaaccagagaccacagcctcatcagctacccatcctgggacacagactggcttcactgttccaattcggactgttccctctagtgagccagatacaatggcttcctgggtcactcatcctccacagaccagcacacctgtttccagaacaacctccagtttttcccatagtagtccagatgccacacctgtaatggccaccagtcctaggacagaagccagttcagctgtactgacaacaatctcacctggtgcaccagagatggtgacttcacagatcactagttctggggcagcaaccagtacaactgttccaactttgactcattctcctggtatgccagagaccacagccttattgagcacccatcccagaacagagacaagtaaaacatttcctgcttcaactgtgtttcctcaagtatcagagaccacagcctcactcaccattagacctggtgcagagactagcacagctctcccaactcagacaacatcctctctcttcaccctacttgtaactggaaccagcagagttgatctaagtccaactgcttcacctggtgtttctgcaaaaacagccccactttccacccatccagggacagaaaccagcacaatgattccaacttcaactctttcccttggtttactagagactacaggcttactggccaccagctcttcagcagagaccagcacgagtactctaactctgactgtttcccctgctgtctctgggctttccagtgcctctataacaactgataagccccaaactgtgacctcctggaacacagaaacctcaccatctgtaacttcagttggacccccagaattttccaggactgtcacaggcaccactatgaccttgataccatcagagatgccaacaccacctaaaaccagtcatggagaaggagtgagtccaaccactatcttgagaactacaatggttgaagccactaatttagctaccacaggttccagtcccactgtggccaagacaacaaccaccttcaatacactggctggaagcctctttactcctctgaccacacctgggatgtccaccttggcctctgagagtgtgacctcaagaacaagttataaccatcggtcctggatctccaccaccagcagttataaccgtcggtactggacccctgccaccagcactccagtgacttctacattctccccagggatttccacatcctccatccccagctccacagcagccacagtcccattcatggtgccattcaccctcaacttcaccatcaccaacctgcagtacgaggaggacatgcggcaccctggttcaaggaagttcaacgccacagagagagaactgcagggtctgctcaaacccttgttcaggaatagcagtctggaatacctctattcaggctgcagactagcctcactcaggccagagaaggatagctcagccacggcagtggatgccatctgcacacatcgccctgaccctgaagacctcggactggacagagagcgactgtactgggagctgagcaatctgacaaatggcatccaggagctgggcccttacaccctggaccggaacagtctctatgtcaatggtttcacccatcgaagctctatgcccaccaccagcactcctgggacctccacagtggatgtgggaacctcagggactccatcctccagccccagccccacgactgctggccctctcctgatgccgttcaccctcaacttcaccatcaccaacctgcagtacgaggaggacatgcgtcgcactggctccaggaagttcaacaccatggagagtgtcctgcagggtctgctcaagccattgttcaagaacaccagtgttggccctttgtactctggctgcagattgaccttgctcaggcccgagaaagatggggcagccactggagtggatgccatctgcacccaccgccttgaccccaaaagccctggactcaacagggagcagctgtactgggagctaagcaaactgaccaatgacattgaagagctgggcccctacaccctggacaggaacagtctctatgtcaatggtttcacccatcagagctctgtgtccaccaccagcactcctgggacctccacagtggatctcagaacctcagggactccatcctccctctccagccccacaattatggctgctggccctctcctggtaccattcaccctcaacttcaccatcaccaacctgcagtatggggaggacatgggtcaccctggctccaggaagttcaacaccacagagagggtcctgcagggtctgcttggtcccatattcaagaacaccagtgttggccctctgtactctggctgcagactgacctctctcaggtccgagaaggatggagcagccactggagtggatgccatctgcatccatcatcttgaccccaaaagccctggactcaacagagagcggctgtactgggagctgagccaactgaccaatggcatcaaagagctgggcccctacaccctggacaggaacagtctctatgtcaatggtttcacccatcggacctctgtgcccaccaccagcactcctgggacctccacagtggaccttggaacctcagggactccattctccctcccaagccccgcaactgctggccctctcctggtgctgttcaccctcaacttcaccatcaccaacctgaagtatgaggaggacatgcatcgccctggctccaggaagttcaacaccactgagagggtcctgcagaccctggttggtcctatgttcaagaacaccagtgttggccttctgtactctggctgcagactgaccttgctcaggtccgagaaggatggagcagccactggagtggatgccatctgcacccaccgtcttgaccccaaaagccctggagtggacagggagcagctatactgggagctgagccaactgaccaatggcatcaaagagctgggcccctacaccctggacaggaacagtctctatgtcaatggtttcacccattggatccctgtgcccaccagcagcacccctgggacctccacagtggaccttgggtcagggactccatcctccctccccagccccacaagtgctactgctggccctctcctggtgccgttcaccctcaacttcaccatcaccaacctgaagtacgaggaggacatgcattgccctggctccaggaagttcaacaccacagagagagtcctgcagagtctgcttggtcccatgttcaagaacaccagtgttggccctctgtactctggctgcagactgaccttgctcaggtccgagaaggatggagcagccactggagtggatgccatctgcacccaccgtcttgaccccaaaagccctggagtggacagggagcagctatactgggagctgagccagctgaccaatggcatcaaagagctgggtccctacaccctggacagaaacagtctctatgtcaatggtttcacccatcagacctctgcgcccaacaccagcactcctgggacctccacagtggaccttgggacctcagggactccatcctccctccccagccctacatctgctggccctctcctggtgccattcaccctcaacttcaccatcaccaacctgcagtacgaggaggacatgcatcacccaggctccaggaagttcaacaccacggagcgggtcctgcagggtctgcttggtcccatgttcaagaacaccagtgtcggccttctgtactctggctgcagactgaccttgctcaggcctgagaagaatggggcagccactggaatggatgccatctgcagccaccgtcttgaccccaaaagccctggactcaacagagagcagctgtactgggagctgagccagctgacccatggcatcaaagagctgggcccctacaccctggacaggaacagtctctatgtcaatggtttcacccatcggagctctgtggcccccaccagcactcctgggacctccacagtggaccttgggacctcagggactccatcctccctccccagccccacaacagctgttcctctcctggtgccgttcaccctcaactttaccatcaccaatctgcagtatggggaggacatgcgtcaccctggctccaggaagttcaacaccacagagagggtcctgcagggtctgcttggtcccttgttcaagaactccagtgtcggccctctgtactctggctgcagactgatctctctcaggtctgagaaggatggggcagccactggagtggatgccatctgcacccaccaccttaaccctcaaagccctggactggacagggagcagctgtactggcagctgagccagatgaccaatggcatcaaagagctgggcccctacaccctggaccggaacagtctctacgtcaatggtttcacccatcggagctctgggctcaccaccagcactccttggacttccacagttgaccttggaacctcagggactccatcccccgtccccagccccacaactgctggccctctcctggtgccattcaccctaaacttcaccatcaccaacctgcagtatgaggaggacatgcatcgccctggatctaggaagttcaacgccacagagagggtcctgcagggtctgcttagtcccatattcaagaactccagtgttggccctctgtactctggctgcagactgacctctctcaggcccgagaaggatggggcagcaactggaatggatgctgtctgcctctaccaccctaatcccaaaagacctgggctggacagagagcagctgtactgggagctaagccagctgacccacaacatcactgagctgggcccctacagcctggacagggacagtctctatgtcaatggtttcacccatcagaactctgtgcccaccaccagtactcctgggacctccacagtgtactgggcaaccactgggactccatcctccttccccggccacacagagcctggccctctcctgataccattcactttcaactttaccatcaccaacctgcattatgaggaaaacatgcaacaccctggttccaggaagttcaacaccacggagagggttctgcagggtctgctcaagcccttgttcaagaacaccagtgttggccctctgtactctggctgcagactgaccttgctcagacctgagaagcaggaggcagccactggagtggacaccatctgtacccaccgcgttgatcccatcggacctggactggacagagagcggctatactgggagctgagccagctgaccaacagcatcacagagctgggaccctacaccctggatagggacagtctctatgtcaatggcttcaacccttggagctctgtgccaaccaccagcactcctgggacctccacagtgcacctggcaacctctgggactccatcctccctgcctggccacacagcccctgtccctctcttgataccattcaccctcaactttaccatcaccaacctgcattatgaagaaaacatgcaacaccctggttccaggaagttcaacaccacggagagggttctgcagggtctgctcaagcccttgttcaagagcaccagcgttggccctctgtactctggctgcagactgaccttgctcagacctgagaaacatggggcagccactggagtggacgccatctgcaccctccgccttgatcccactggtcctggactggacagagagcggctatactgggagctgagccagctgaccaacagcgttacagagctgggcccctacaccctggacagggacagtctctatgtcaatggcttcacccatcggagctctgtgccaaccaccagtattcctgggacctctgcagtgcacctggaaacctctgggactccagcctccctccctggccacacagcccctggccctctcctggtgccattcaccctcaacttcactatcaccaacctgcagtatgaggaggacatgcgtcaccctggttccaggaagttcaacaccacggagagagtcctgcagggtctgctcaagcccttgttcaagagcaccagtgttggccctctgtactctggctgcagactgaccttgctcaggcctgaaaaacgtggggcagccaccggcgtggacaccatctgcactcaccgccttgaccctctaaaccctggactggacagagagcagctatactgggagctgagcaaactgacccgtggcatcatcgagctgggcccctacctcctggacagaggcagtctctatgtcaatggtttcacccatcggaactttgtgcccatcaccagcactcctgggacctccacagtacacctaggaacctctgaaactccatcctccctacctagacccatagtgcctggccctctcctggtgccattcaccctcaacttcaccatcaccaacttgcagtatgaggaggccatgcgacaccctggctccaggaagttcaataccacggagagggtcctacagggtctgctcaggcccttgttcaagaataccagtatcggccctctgtactccagctgcagactgaccttgctcaggccagagaaggacaaggcagccaccagagtggatgccatctgtacccaccaccctgaccctcaaagccctggactgaacagagagcagctgtactgggagctgagccagctgacccacggcatcactgagctgggcccctacaccctggacagggacagtctctatgtcgatggtttcactcattggagccccataccaaccaccagcactcctgggacctccatagtgaacctgggaacctctgggatcccaccttccctccctgaaactacagccaccggccctctcctggtgccattcacactcaacttcaccatcactaacctacagtatgaggagaacatgggtcaccctggctccaggaagttcaacatcacggagagtgttctgcagggtctgctcaagcccttgttcaagagcaccagtgttggccctctgtattctggctgcagactgaccttgctcaggcctgagaaggacggagtagccaccagagtggacgccatctgcacccaccgccctgaccccaaaatccctgggctagacagacagcagctatactgggagctgagccagctgacccacagcatcactgagctgggaccctacaccctggatagggacagtctctatgtcaatggtttcacccagcggagctctgtgcccaccaccagcactcctgggactttcacagtacagccggaaacctctgagactccatcatccctccctggccccacagccactggccctgtcctgctgccattcaccctcaattttaccatcattaacctgcagtatgaggaggacatgcatcgccctggctccaggaagttcaacaccacggagagggtccttcagggtctgcttatgcccttgttcaagaacaccagtgtcagctctctgtactctggttgcagactgaccttgctcaggcctgagaaggatggggcagccaccagagtggatgctgtctgcacccatcgtcctgaccccaaaagccctggactggacagagagcggctgtactggaagctgagccagctgacccacggcatcactgagctgggcccctacaccctggacaggcacagtctctatgtcaatggtttcacccatcagagctctatgacgaccaccagaactcctgatacctccacaatgcacctggcaacctcgagaactccagcctccctgtctggacctacgaccgccagccctctcctggtgctattcacaattaacttcaccatcactaacctgcggtatgaggagaacatgcatcaccctggctctagaaagtttaacaccacggagagagtccttcagggtctgctcaggcctgtgttcaagaacaccagtgttggccctctgtactctggctgcagactgaccttgctcaggcccaagaaggatggggcagccaccaaagtggatgccatctgcacctaccgccctgatcccaaaagccctggactggacagagagcagctatactgggagctgagccagctaacccacagcatcactgagctgggcccctacaccctggacagggacagtctctatgtcaatggtttcacacagcggagctctgtgcccaccactagcattcctgggacccccacagtggacctgggaacatctgggactccagtttctaaacctggtccctcggctgccagccctctcctggtgctattcactctcaacttcaccatcaccaacctgcggtatgaggagaacatgcagcaccctggctccaggaagttcaacaccacggagagggtccttcagggcctgctcaggtccctgttcaagagcaccagtgttggccctctgtactctggctgcagactgactttgctcaggcctgaaaaggatgggacagccactggagtggatgccatctgcacccaccaccctgaccccaaaagccctaggctggacagagagcagctgtattgggagctgagccagctgacccacaatatcactgagctgggcccctatgccctggacaacgacagcctctttgtcaatggtttcactcatcggagctctgtgtccaccaccagcactcctgggacccccacagtgtatctgggagcatctaagactccagcctcgatatttggcccttcagctgccagccatctcctgatactattcaccctcaacttcaccatcactaacctgcggtatgaggagaacatgtggcctggctccaggaagttcaacactacagagagggtccttcagggcctgctaaggcccttgttcaagaacaccagtgttggccctctgtactctggctgcaggctgaccttgctcaggccagagaaagatggggaagccaccggagtggatgccatctgcacccaccgccctgaccccacaggccctgggctggacagagagcagctgtatttggagctgagccagctgacccacagcatcactgagctgggcccctacacactggacagggacagtctctatgtcaatggtttcacccatcggagctctgtacccaccaccagcaccggggtggtcagcgaggagccattcacactgaacttcaccatcaacaacctgcgctacatggcggacatgggccaacccggctccctcaagttcaacatcacagacaacgtcatgcagcacctgctcagtcctttgttccagaggagcagcctgggtgcacggtacacaggctgcagggtcatcgcactaaggtctgtgaagaacggtgctgagacacgggtggacctcctctgcacctacctgcagcccctcagcggcccaggtctgcctatcaagcaggtgttccatgagctgagccagcagacccatggcatcacccggctgggcccctactctctggacaaagacagcctctaccttaacggttacaatgaacctggtccagatgagcctcctacaactcccaagccagccaccacattcctgcctcctctgtcagaagccacaacagccatggggtaccacctgaagaccctcacactcaacttcaccatctccaatctccagtattcaccagatatgggcaagggctcagctacattcaactccaccgagggggtccttcagcacctgctcagacccttgttccagaagagcagcatgggccccttctacttgggttgccaactgatctccctcaggcctgagaaggatggggcagccactggtgtggacaccacctgcacctaccaccctgaccctgtgggccccgggctggacatacagcagctttactgggagctgagtcagctgacccatggtgtcacccaactgggcttctatgtcctggacagggatagcctcttcatcaatggctatgcaccccagaatttatcaatccggggcgagtaccagataaatttccacattgtcaactggaacctcagtaatccagaccccacatcctcagagtacatcaccctgctgagggacatccaggacaaggtcaccacactctacaaaggcagtcaactacatgacacattccgcttctgcctggtcaccaacttgacgatggactccgtgttggtcactgtcaaggcattgttctcctccaatttggaccccagcctggtggagcaagtctttctagataagaccctgaatgcctcattccattggctgggctccacctaccagttggtggacatccatgtgacagaaatggagtcatcagtttatcaaccaacaagcagctccagcacccagcacttctacctgaatttcaccatcaccaacctaccatattcccaggacaaagcccagccaggcaccaccaattaccagaggaacaaaaggaatattgaggatgcgctcaaccaactcttccgaaacagcagcatcaagagttatttttctgactgtcaagtttcaacattcaggtctgtccccaacaggcaccacaccggggtggactccctgtgtaacttctcgccactggctcggagagtagacagagttgccatctatgaggaatttctgcggatgacccggaatggtacccagctgcagaacttcaccctggacaggagcagtgtccttgtggatgggtattctcccaacagaaatgagcccttaactgggaattctgaccttcccttctgggctgtcatcctcatcggcttggcaggactcctgggactcatcacatgcctgatctgcggtgtcctggtgaccacccgccggcggaagaaggaaggagaatacaacgtccagcaacagtgcccaggctactaccagtcacacctagacctggaggatctgcaatgactggaacttgccggtgcctggggtgcctttcccccagccagggtccaaagaagcttggctggggcagaaataaaccatattggtcggaaaaaaaaaaaaaaaaaaaaaaaaaaaaaaaaaaaaa

SEQ ID NO: 52 - protein, 6995 aa, Homo sapiens
PVTSLLTPGLVITTDRMGISREPGTSSTSNLSSTSHERLTTLEDTVDTEAMQPSTHTAVTNVRTSISGHESQSSVLSDSETPKATSPMGTTYTMGETSVSISTSDFFETSRIQIEPTSSLTSGLRETSSSERISSATEGSTVLSEVPSGATTEVSRTEVISSRGTSMSGPDQFTISPDISTEAITRLSTSPIMTESAESAITIETGSPGATSEGTLTLDTSTTTFWSGTHSTASPGFSHSEMTTLMSRTPGDVPWPSLPSVEEASSVSSSLSSPAMTSTSFFSTLPESISSSPHPVTALLTLGPVKTTDMLRTSSEPETSSPPNLSSTSAEILATSEVTKDREKIHPSSNTPVVNVGTVIYKHLSPSSVLADLVTTKPTSPMATTSTLGNTSVSTSTPAFPETMMTQPTSSLTSGLREISTSQETSSATERSASLSGMPTGATTKVSRTEALSLGRTSTPGPAQSTISPEISTETITRISTPLTTTGSAEMTITPKTGHSGASSQGTFTLDTSSRASWPGTHSAATHRSPHSGMTTPMSRGPEDVSWPSRPSVEKTSPPSSLVSLSAVTSPSPLYSTPSESSHSSPLRVTSLFTPVMMKTTDMLDTSLEPVTTSPPSMNITSDESLATSKATMETEAIQLSENTAVTQMGTISARQEFYSSYPGLPEPSKVTSPVVTSSTIKDIVSTTIPASSEITRIEMESTSTLTPTPRETSTSQEIHSATKPSTVPYKALTSATIEDSMTQVMSSSRGPSPDQSTMSQDISTEVITRLSTSPIKTESTEMTITTQTGSPGATSRGTLTLDTSTTFMSGTHSTASQGFSHSQMTALMSRTPGEVPWLSHPSVEEASSASFSLSSPVMTSSSPVSSTLPDSIHSSSLPVTSLLTSGLVKTTELLGTSSEPETSSPPNLSSTSAEILATTEVTTDTEKLEMTNVVTSGYTHESPSSVLADSVTTKATSSMGITYPTGDTNVLTSTPAFSDTSRIQTKSKLSLTPGLMETSISEETSSATEKSTVLSSVPTGATTEVSRTEAISSSRTSIPGPAQSTMSSDTSMETITRISTPLTRKESTDMAITPKTGPSGATSQGTFTLDSSSTASWPGTHSATTQRFPRSVVTTPMSRGPEDVSWPSPLSVEKNSPPSSLVSSSSVTSPSPLYSTPSGSSHSSPVPVTSLFTSIMMKATDMLDASLEPETTSAPNMNITSDESLAASKATTETEAIHVFENTAASHVETTSATEELYSSSPGFSEPTKVISPVVTSSSIRDNMVSTTMPGSSGITRIEIESMSSLTPGLRETRTSQDITSSTETSTVLYKMPSGATPEVSRTEVMPSSRTSIPGPAQSTMSLDISDEVVTRLSTSPIMTESAEITITTQTGYSLATSQVTLPLGTSMTFLSGTHSTMSQGLSHSEMTNLMSRGPESLSWTSPRFVETTRSSSSLTSLPLTTSLSPVSSTLLDSSPSSPLPVTSLILPGLVKTTEVLDTSSEPKTSSSPNLSSTSVEIPATSEIMTDTEKIHPSSNTAVAKVRTSSSVHESHSSVLADSETTITIPSMGITSAVEDTTVFTSNPAFSETRRIPTEPTFSLTPGFRETSTSEETTSITETSAVLFGVPTSATTEVSMTEIMSSNRTHIPDSDQSTMSPDIITEVITRLSSSSMMSESTQMTITTQKSSPGATAQSTLTLATTTAPLARTHSTVPPRFLHSEMTTLMSRSPENPSWKSSPFVEKTSSSSSLLSLPVTTSPSVSSTLPQSIPSSSFSVTSLLTPGMVKTTDTSTEPGTSLSPNLSGTSVEILAASEVTTDTEKIHPSSSMAVTNVGTTSSGHELYSSVSIHSEPSKATYPVGTPSSMAETSISTSMPANFETTGFEAEPFSHLTSGLRKTNMSLDTSSVTPTNTPSSPGSTHLLQSSKTDFTSSAKTSSPDWPPASQYTEIPVDIITPFNASPSITESTGITSFPESRFTMSVTESTHHLSTDLLPSAETISTGTVMPSLSEAMTSFATTGVPRAISGSGSPFSRTESGPGDATLSTIAESLPSSTPVPFSSSTFTTTDSSTIPALHEITSSSATPYRVDTSLGTESSTTEGRLVMVSTLDTSSQPGRTSSSPILDTRMTESVELGTVTSAYQVPSLSTRLTRTDGIMEHITKIPNEAAHRGTIRPVKGPQTSTSPASPKGLHTGGTKRMETTTTALKTTTTALKTTSRATLTTSVYTPTLGTLTPLNASMQMASTIPTEMMITTPYVFPDVPETTSSLATSLGAETSTALPRTTPSVFNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHSAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTFLVTSSRAVTSTTIPTLTISSDEPETTTSLVTHSEAKMISAIPTLGVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPDASKMLTSLVISSGTDSTTTFPTLTETPYEPETTAIQLIHPAETNTMVPRTTPKFSHSKSDTTLPVAITSPGPEASSAVSTTTISPDMSDLVTSLVPSSGTDTSTTFPTLSETPYEPETTATWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTETSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSATAVDAICTHRPDPEDLGLDRERLYWELSNLTNGIQELGPYTLDRNSLYVNGFTHRSSMPTTSTPGTSTVDVGTSGTPSSSPSPTTAGPLLMPFTLNFTITNLQYEEDMRRTGSRKFNTMESVLQGLLKPLFKNTSVGPLYSGCRLTLLRPEKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLVPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTTSTPGTSTVDLGTSGTPFSLPSPATAGPLLVLFTLNFTITNLKYEEDMHRPGSRKFNTTERVLQTLVGPMFKNTSVGLLYSGCRLTLLRSEKDGAATGVDAICTHRLDPKSPGVDREQLYWELSQLTNGIKELGPYTLDRNSLYVNGFTHWIPVPTSSTPGTSTVDLGSGTPSSLPSPTSATAGPLLVPFTLNFTITNLKYEEDMHCPGSRKFNTTERVLQSLLGPMFKNTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTAGPLLVPFTLNFTITNLQYEEDMHRPGSRKFNATERVLQGLLSPIFKNSSVGPLYSGCRLTSLRPEKDGAATGMDAVCLYHPNPKRPGLDREQLYWELSQLTHNITELGPYSLDRDSLYVNGFTHQNSVPTTSTPGTSTVYWATTGTPSSFPGHTEPGPLLIPFTFNFTITNLHYEENMQHPGSRKFNTTERVLQGLLKPLFKNTSVGPLYSGCRLTLLRPEKQEAATGVDTICTHRVDPIGPGLDRERLYWELSQLTNSITELGPYTLDRDSLYVNGFNPWSSVPTTSTPGTSTVHLATSGTPSSLPGHTAPVPLLIPFTLNFTITNLHYEENMQHPGSRKFNTTERVLQGLLKPLFKSTSVGPLYSGCRLTLLRPEKHGAATGVDAICTLRLDPTGPGLDRERLYWELSQLTNSVTELGPYTLDRDSLYVNGFTHRSSVPTTSIPGTSAVHLETSGTPASLPGHTAPGPLLVPFTLNFTITNLQYEEDMRHPGSRKFNTTERVLQGLLKPLFKSTSVGPLYSGCRLTLLRPEKRGAATGVDTICTHRLDPLNPGLDREQLYWELSKLTRGIIELGPYLLDRGSLYVNGFTHRNFVPITSTPGTSTVHLGTSETPSSLPRPIVPGPLLVPFTLNFTITNLQYEEAMRHPGSRKFNTTERVLQGLLRPLFKNTSIGPLYSSCRLTLLRPEKDKAATRVDAICTHHPDPQSPGLNREQLYWELSQLTHGITELGPYTLDRDSLYVDGFTHWSPIPTTSTPGTSIVNLGTSGIPPSLPETTATGPLLVPFTLNFTITNLQYEENMGHPGSRKFNITESVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTIINLQYEEDMHRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPTTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGPYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGCRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMQHLLSPLFQRSSLGARYTGCRVIALRSVKNGAETRVDLLCTYLQPLSGPGLPIKQVFHELSQQTHGITRLGPYSLDKDSLYLNGYNEPGPDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGLITCLICGVLVTTRRRKKEGEYNVQQQCPGYYQSHLDLEDLQ

SEQ ID NO: 53 - DNA, 2187 bp, Homo sapiens
tgccaggctctccacccccacttcccaattgaggaaaccgaggcagaggaggctcagcgccacgcactcctctttctgcctggccggccactcccgtctgctgtgacgcgcggacagagagctaccggtggacccacggtgcctccctccctgggatctacacagaccatggccttgccaacggctcgacccctgttggggtcctgtgggacccccgccctcggcagcctcctgttcctgctcttcagcctcggatgggtgcagccctcgaggaccctggctggagagacagggcaggaggctgcgcccctggacggagtcctggccaacccacctaacatttccagcctctcccctcgccaactccttggcttcccgtgtgcggaggtgtccggcctgagcacggagcgtgtccgggagctggctgtggccttggcacagaagaatgtcaagctctcaacagagcagctgcgctgtctggctcaccggctctctgagccccccgaggacctggacgccctcccattggacctgctgctattcctcaacccagatgcgttctcggggccccaggcctgcacccgtttcttctcccgcatcacgaaggccaatgtggacctgctcccgaggggggctcccgagcgacagcggctgctgcctgcggctctggcctgctggggtgtgcgggggtctctgctgagcgaggctgatgtgcgggctctgggaggcctggcttgcgacctgcctgggcgctttgtggccgagtcggccgaagtgctgctaccccggctggtgagctgcccgggacccctggaccaggaccagcaggaggcagccagggcggctctgcagggcgggggacccccctacggccccccgtcgacatggtctgtctccacgatggacgctctgcggggcctgctgcccgtgctgggccagcccatcatccgcagcatcccgcagggcatcgtggccgcgtggcggcaacgctcctctcgggacccatcctggcggcagcctgaacggaccatcctccggccgcggttccggcgggaagtggagaagacagcctgtccttcaggcaagaaggcccgcgagatagacgagagcctcatcttctacaagaagtgggagctggaagcctgcgtggatgcggccctgctggccacccagatggaccgcgtgaacgccatccccttcacctacgagcagctggacgtcctaaagcataaactggatgagctctacccacaaggttaccccgagtctgtgatccagcacctgggctacctcttcctcaagatgagccctgaggacattcgcaagtggaatgtgacgtccctggagaccctgaaggctttgcttgaagtcaacaaagggcacgaaatgagtcctcaggtggccaccctgatcgaccgctttgtgaagggaaggggccagctagacaaagacaccctagacaccctgaccgccttctaccctgggtacctgtgctccctcagccccgaggagctgagctccgtgccccccagcagcatctgggcggtcaggccccaggacctggacacgtgtgacccaaggcagctggacgtcctctatcccaaggcccgccttgctttccagaacatgaacgggtccgaatacttcgtgaagatccagtccttcctgggtggggcccccacggaggatttgaaggcgctcagtcagcagaatgtgagcatggacttggccacgttcatgaagctgcggacggatgcggtgctgccgttgactgtggctgaggtgcagaaacttctgggaccccacgtggagggcctgaaggcggaggagcggcaccgcccggtgcgggactggatcctacggcagcggcaggacgacctggacacgctggggctggggctacagggcggcatccccaacggctacctggtcctagacctcagcatgcaagaggccctctcggggacgccctgcctcctaggacctggacctgttctcaccgtcctggcactgctcctagcctccaccctggcctgagggccccactcccttgctggccccagccctgctggggatccccgcctggccaggagcaggcacgggtggtccccgttccaccccaagagaactcgcgctcagtaaacgggaacatgccccctgcagacacgtaaaaaaaaaaaaaaaaaa

SEQ ID NO: 54 - protein, 622 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 55 - DNA, 4167 bp, Homo sapiens
accttcgccatatatacccggggcgctgcgctccacctggccgccgcctccagcccagcacctgcggagggagcgctgaccatggctccctggcctgaattgggagatgcccagcccaaccccgataagtacctcgaaggggccgcaggtcagcagcccactgcccctgataaaagcaaagagaccaacaaaacagataacactgaggcacctgtaaccaagattgaacttctgccgtcctactccacggctacactgatagatgagcccactgaggtggatgacccctggaacctacccactcttcaggactcggggatcaagtggtcagagagagacaccaaagggaagattctctgtttcttccaagggattgggagattgattttacttctcggatttctctactttttcgtgtgctccctggatattcttagtagcgccttccagctggttggaggaaaaatggcaggacagttcttcagcaacagctctattatgtccaaccctttgttggggctggtgatcggggtgctggtgaccgtcttggtgcagagctccagcacctcaacgtccatcgttgtcagcatggtgtcctcttcattgctcactgttcgggctgccatccccattatcatgggggccaacattggaacgtcaatcaccaacactattgttgcgctcatgcaggtgggagatcggagtgagttcagaagagcttttgcaggagccactgtccatgacttcttcaactggctgtccgtgttggtgctcttgcccgtggaggtggccacccattacctcgagatcataacccagcttatagtggagagcttccacttcaagaatggagaagatgccccagatcttctgaaagtcatcactaagcccttcacaaagctcattgtccagctggataaaaaagttatcagccaaattgcaatgaacgatgaaaaagcgaaaaacaagagtcttgtcaagatttggtgcaaaacttttaccaacaagacccagattaacgtcactgttccctcgactgctaactgcacctccccttccctctgttggacggatggcatccaaaactggaccatgaagaatgtgacctacaaggagaacatcgccaaatgccagcatatctttgtgaatttccacctcccggatcttgctgtgggcaccatcttgctcatactctccctgctggtcctctgtggttgcctgatcatgattgtcaagatcctgggctctgtgctcaaggggcaggtcgccactgtcatcaagaagaccatcaacactgatttcccctttccctttgcatggttgactggctacctggccatcctcgtcggggcaggcatgaccttcatcgtacagagcagctctgtgttcacgtcggccttgacccccctgattggaatcggcgtgataaccattgagagggcttatccactcacgctgggctccaacatcggcaccaccaccaccgccatcctggccgccttagccagccctggcaatgcattgaggagttcactccagatcgccctgtgccactttttcttcaacatctccggcatcttgctgtggtacccgatcccgttcactcgcctgcccatccgcatggccaaggggctgggcaacatctctgccaagtatcgctggttcgccgtcttctacctgatcatcttcttcttcctgatcccgctgacggtgtttggcctctcgctggccggctggcgggtgctggttggtgtcggggttcccgtcgtcttcatcatcatcctggtactgtgcctccgactcctgcagtctcgctgcccacgcgtcctgccgaagaaactccagaactggaacttcctgccgctgtggatgcgctcgctgaagccctgggatgccgtcgtctccaagttcaccggctgcttccagatgcgctgctgctgctgctgccgcgtgtgctgccgcgcgtgctgcttgctgtgtggctgccccaagtgctgccgctgcagcaagtgctgcgaggacttggaggaggcgcaggaggggcaggatgtccctgtcaaggctcctgagacctttgataacataaccattagcagagaggctcagggtgaggtccctgcctcggactcaaagaccgaatgcacggccttgtaggggacgccccagattgtcagggatggggggatggtccttgagttttgcatgctctcctccctcccacttctgcaccctttcaccacctcgaggagatttgctccccattagcgaatgaaattgatgcagtcctacctaactcgattccctttggcttggtggtaggcctgcagggcacttttattccaacccctggtcactcagtaatcttttactccaggaaggcacaggatggtacctaaagagaattagagaatgaacctggcgggacggatgtctaatcctgcgcctagctgggttggtcagtagaacctattttcagactcaaaaaccatcttcagaaagaaaaggcccagggaaggaatgtatgagaggctctcccagatgaggaagtgtactctctatgactatcaagctcaggcctctccctttttttaaaccaaagtctggcaaccaagagcagcagctccatggcctccttgccccagatcagcctgggtcaggggacatagtgtcattgtttggaaactgcagaccacaaggtgtgggtctatcccacttcctagtgctccccacattccccatcagggcttcctcacgtggacaggtgtgctagtccaggcagttcacttgcagtttccttgtcctcatgcttcggggatgggagccacgcctgaactagagttcaggctggatacatgtgctcacctgctgctcttgtcttcctaagagacagagagtggggcagatggaggagaagaaagtgaggaatgagtagcatagcattctgccaaaagggccccagattcttaatttagcaaactaagaagcccaattcaaaagcattgtggctaaagtctaacgctcctctcttggtcagataacaaaagccctccctgttggatcttttgaaataaaacgtgcaagttatccaggctcgtagcctgcatgctgccaccttgaatcccagggagtatctgcacctggaatagctctccacccctctctgcctccttactttctgtgcaagatgacttcctgggttaacttccttctttccatccacccacccactggaatctctttccaaacatttttccattttcccacagatgggctttgattagctgtcctctctccatgcctgcaaagctccagatttttggggaaagctgtacccaactggactgcccagtgaactgggatcattaagtacagtcgagcacacgtgtgtgcatgggtcaaaggggtgtgttccttctcatcctagatgccttctctgtgccttccacagcctcctgcctgattacaccactgcccccgccccaccctcagccatcccaattcttcctggccagtgcgctccagccttatctaggaaaggaggagtgggtgtagccgtgcagcaagattggggcctcccccatcccagcttctccaccatcccagcaagtcaggatatcagacagtcctcccctgaccctcccccttgtagatatcaattcccaaacagagccaaatactctatatctatagtcacagccctgtacagcatttttcataagttatatagtaaatggtctgcatgatttgtgcttctagtgctctcatttggaaatgaggcaggcttcttctatgaaatgtaaagaaagaaaccactttgtatattttgtaataccacctctgtggccatgcctgccccgcccactctgtatatatgtaagttaaacccgggcaggggctgtggccgtctttgtactctggtgatttttaaaaattgaatctttgtacttgcattgattgtataataattttgagaccaggtctcgctgtgttgctcaggctggtctcaaactcctgagatcaagcaatccgcccacctcagcctcccaaagtgctgagatcacaggcgtgagccaccaccaggcctgattgtaatttttttttttttttttttactggttatgggaagggagaaataaaatcatcaaacccaaaaaaaaaaaaaaaaaa

SEQ ID NO: 56 - protein, 690 aa, Homo sapiens
MAPWPELGDAQPNPDKYLEGAAGQQPTAPDKSKETNKTDNTEAPVTKIELLPSYSTATLIDEPTEVDDPWNLPTLQDSGIKWSERDTKGKILCFFQGIGRLILLLGFLYFFVCSLDILSSAFQLVGGKMAGQFFSNSSIMSNPLLGLVIGVLVTVLVQSSSTSTSIVVSMVSSSLLTVRAAIPIIMGANIGTSITNTIVALMQVGDRSEFRRAFAGATVHDFFNWLSVLVLLPVEVATHYLEIITQLIVESFHFKNGEDAPDLLKVITKPFTKLIVQLDKKVISQIAMNDEKAKNKSLVKIWCKTFTNKTQINVTVPSTANCTSPSLCWTDGIQNWTMKNVTYKENIAKCQHIFVNFHLPDLAVGTILLILSLLVLCGCLIMIVKILGSVLKGQVATVIKKTINTDFPFPFAWLTGYLAILVGAGMTFIVQSSSVFTSALTPLIGIGVITIERAYPLTLGSNIGTTTTAILAALASPGNALRSSLQIALCHFFFNISGILLWYPIPFTRLPIRMAKGLGNISAKYRWFAVFYLIIFFFLIPLTVFGLSLAGWRVLVGVGVPVVFIIILVLCLRLLQSRCPRVLPKKLQNWNFLPLWMRSLKPWDAVVSKFTGCFQMRCCCCCRVCCRACCLLCGCPKCCRCSKCCEDLEEAQEGQDVPVKAPETFDNITISREAQGEVPASDSKTECTAL

SEQ ID NO: 57 - DNA, 4559 bp, Homo sapiens
gcggccgccccattcccagaccggccgccagcccatctggttagctcccgccgctccgcgccgcccgggagtcgggagccgcggggaaccgggcacctgcacccgcctctgggagtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactactgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccagagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggacctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccggctgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctctcatggttatcttccaacccactgtcacgctgacactatgctgccatgcctgggctgtggacctactgggcatttgaggaactggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccacaggaggcagaagtctggcctctgtgcctctatggagactatcttccagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtctcc

SEQ ID NO: 58 - protein, 1202 aa, Homo sapiens
AAAPFPDRPPAHLVSSRRSAPPGSREPRGTGHLHPPLGVSGSSWCLACVSWMPCGFSPSPVAHHLVPGPPDTPAQQLRCGWTVGGWLLSLVRGLLPCLPPGARTAEGPIMVLAGPLAVSLLLPSLTLLVSHLSSSQDVSSEPSSEQQLCALSKHPTVAFEDLQPWVSNFTYPGARDFSQLALDPSGNQLIVGARNYLFRLSLANVSLLQATEWASSEDTRRSCQSKGKTEEECQNYVRVLIVAGRKVFMCGTNAFSPMCTSRQVGNLSRTTEKINGVARCPYDPRHNSTAVISSQGELYAATVIDFSGRDPAIYRSLGSGPPLRTAQYNSKWLNEPNFVAAYDIGLFAYFFLRENAVEHDCGRTVYSRVARVCKNDVGGRFLLEDTWTTFMKARLNCSRPGEVPFYYNELQSAFHLPEQDLIYGVFTTNVNSIAASAVCAFNLSAISQAFNGPFRYQENPRAAWLPIANPIPNFQCGTLPETGPNENLTERSLQDAQRLFLMSEAVQPVTPEPCVTQDSVRFSHLVVDLVQAKDTLYHVLYIGTESGTILKALSTASRSLHGCYLEELHVLPPGRREPLRSLRILHSARALFVGLRDGVLRVPLERCAAYRSQGACLGARDPYCGWDGKQQRCSTLEDSSNMSLWTQNITACPVRNVTRDGGFGPWSPWQPCEHLDGDNSGSCLCRARSCDSPRPRCGGLDCLGPAIHIANCSRNGAWTPWSSWALCSTSCGIGFQVRQRSCSNPAPRHGGRICVGKSREERFCNENTPCPVPIFWASWGSWSKCSSNCGGGMQSRRRACENGNSCLGCGVEFKTCNPEGCPEVRRNTPWTPWLPVNVTQGGARQEQRFRFTCRAPLADPHGLQFGRRRTETRTCPADGSGSCDTDALVEDLLRSGSTSPHTVSGGWAAWGPWSSCSRDCELGFRVRKRTCTNPEPRNGGLPCVGDAAEYQDCNPQACPVRGAWSCWTSWSPCSASCGGGHYQRTRSCTSPAPSPGEDICLGLHTEEALCATQACPEGWSPWSEWSKCTDDGAQSRSRHCEELLPGSSACAGNSSQSRPCPYSEIPVILPASSMEEATGCAGFNLIHLVATGISCFLGSGLLTLAVYLSCQHCQRQSQESTLVHPATPNHLHYKGGGTPKNEKYTPMEFKTLNKNNLIPDDRANFYPLQQTNVYTTTYYPSPLNKHSFRPEASPGQRCFPNS

SEQ ID NO: 59 - DNA, 1524 bp, Homo sapiens
gcggcagcagcgcgggccccagcagcctcggcagccacagccgctgcagccggggcagcctccgctgctgtcgcctcctctgatgcgcttgccctctcccggccccgggactccgggagaatgtgggtcctaggcatcgcggcaactttttgcggattgttcttgcttccaggctttgcgctgcaaatccagtgctaccagtgtgaagaattccagctgaacaacgactgctcctcccccgagttcattgtgaattgcacggtgaacgttcaagacatgtgtcagaaagaagtgatggagcaaagtgccgggatcatgtaccgcaagtcctgtgcatcatcagcggcctgtctcatcgcctctgccgggtaccagtccttctgctccccagggaaactgaactcagtttgcatcagctgctgcaacacccctctttgtaacgggccaaggcccaagaaaaggggaagttctgcctcggccctcaggccagggctccgcaccaccatcctgttcctcaaattagccctcttctcggcacactgctgaagctgaaggagatgccaccccctcctgcattgttcttccagccctcgcccccaaccccccacctccctgagtgagtttcttctgggtgtccttttattctgggtagggagcgggagtccgtgttctcttttgttcctgtgcaaataatgaaagagctcggtaaagcattctgaataaattcagcctgactgaattttcagtatgtacttgaaggaaggaggtggagtgaaagttcacccccatgtctgtgtaaccggagtcaaggccaggctggcagagtcagtccttagaagtcactgaggtgggcatctgccttttgtaaagcctccagtgtccattccatccctgatgggggcatagtttgagactgcagagtgagagtgacgttttcttagggctggagggccagttcccactcaaggctccctcgcttgacattcaaacttcatgctcctgaaaaccattctctgcagcagaattggctggtttcgcgcctgagttgggctctagtgactcgagactcaatgactgggacttagactggggctcggcctcgctctgaaaagtgcttaagaaaatcttctcagttctccttgcagaggactggcgccgggacgcgaagagcaacgggcgctgcacaaagcgggcgctgtcggtggtggagtgcgcatgtacgcgcaggcgcttctcgtggttggcgtgctgcagcgacaggcggcagcacagcacctgcacgaacacccgccgaaactgctgcgaggacaccgtgtacaggagcgggttgatgaccgagctgaggtagaaaaacgtctccgagaaggggaggaggatcatgtacgcccggaagtaggacctcgtccagtcgtgcttgggtttggccgcagccatgatcctccgaatctggttgggcatccagcatacggccaatgtcacaacaatcagccctgggcagacacgagcaggagggagagacagaga

SEQ ID NO: 60 - protein, 141 aa, Homo sapiens
MWVLGIAATFCGLFLLPGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLALFSAHC

SEQ ID NO: 61 - DNA, 1329 bp, Homo sapiens
atgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctattcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttga

SEQ ID NO: 62 - protein, 442 aa, Homo sapiens
MQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKSCLCCWCQSFEEKQSLEEKQSCLKFKANDHGYDNFRSSNKYSSS

SEQ ID NO: 63 - DNA, 4573 bp, Homo sapiens
agaacaccaattacaaaccacaggcttcctgctctagggagttgatccagaattgtctttctgaaaggaagcactcggaatccttccgaactttccaagtccatccatgattcagagatactgccttctctctctctgggattttatgtgtttctgatagtgaattgttgatgtatttgctactttgcttcttttctctttcaagacttgatcattttatatgctgtttggagaaaaaaagaacttttgttagcaaggaggtttcagaaatgattttggattttctgtaagtgtttaatttagttctaggggacagcatctctcatcccggagtaaatttctgcctttgacctgcatggattattttttcaggctgcggaatttctcggcacctacctgtagtatggggcacttggtttggttgcagagtaagaaggtggaagaatgagctgtacttggttaagcagttgaaaccttttttgagcaggatctgtaaaagcataattgaatttgtttcacccccgtggattccagtgggcccgacagcgcaacagtgcctggcaacttgatgcatatggaagagcaatgccaagtgatctgacataatacaaattcacgaagtgacattcaatcacaagcaaagttggaaattccaaagagaagtggtgagatctttactagtcacagtgaagatgggagaaaatgacatacctgcagcagatgtgggctgaaaatatcctcttctctgcccaatcaggaatgctacctgtttttgggaataaactttagagaaaggaagggccaaaactacgacttggctttctgaaacggaagcataaatgttcttttcctccatttgtctggatctgagaacctgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctattatcagagtgatccccttgaaaatggaccccacaggaaaactgaatctcactttggaaggtgtgtttgctggtgttgctgaaataactccagcagaaggaaaattaatgcagtcccacccgctgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccagatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcaggcctagctccaaccaagagtgtgctccagatgtgtttgggccctacctggcacagagtcctgctcctgggaaaggaaaggaccacagcaaacaccattctttttgccgtacttcctagaagcactggaagaggactggtgatggtggagggtgagagggtgccgtttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctagctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccagctttggcccctccacagtaaggctgctacatcaggggcaaccctggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagaggcccagctccccagtataagccatacaggccagggacccacaggagagtggattagagcacaagtctggcctcactgagtggacaagagctgatgggcctcatcagggtgacattcaccccagggcagcctgaccactcttggcccctcaggcattatcccatttggaatgtgaatgtggtggcaaagtgggcagaggaccccacctgggaacctttttccctcagttagtggggagactagcacctaggtacccacatgggtatttatatctgaaccagacagacgcttgaatcaggcactatgttaagaaatatatttatttgctaatatatttatccacaaaaaaaaaaaaaaaaaa

SEQ ID NO: 64 - protein, 783 aa, Homo sapiens
MSGGHQLQLAALWPWLLMATLQAGFGRTGLVLAAAVESERSAEQKAIIRVIPLKMDPTGKLNLTLEGVFAGVAEITPAEGKLMQSHPLYLCNASDDDNLEPGFISIVKLESPRRAPRPCLSLASKARMAGERGASAVLFDITEDRAAAEQLQQPLGLTWPVVLIWGNDAEKLMEFVYKNQKAHVRIELKEPPAWPDYDVWILMTVVGTIFVIILASVLRIRCRPRHSRPDPLQQRTAWAISQLATRRYQASCRQARGEWPDSGSSCSSAPVCAICLEEFSEGQELRVISCLHEFHRNCVDPWLHQHRTCPLCMFNITEGDSFSQSLGPSRSYQEPGRRLHLIRQHPGHAHYHLPAAYLLGPSRSAVARPPRPGPFLPSQEPGMGPRHHRFPRAAHPRAPGEQQRLAGAQHPYAQGWGLSHLQSTSQHPAACPVPLRRARPPDSSGSGESYCTERSGYLADGPASDSSSGPCHGSSSDSVVNCTDISLQGVHGSSSTFCSSLSSDFDPLVYCSPKGDPQRVDMQPSVTSRPRSLDSVVPTGETQVSSHVHYHRHRHHHYKKRFQWHGRKPGPETGVPQSRPPIPRTQPQPEPPSPDQQVTRSNSAAPSGRLSNPQCPRALPEPAPGPVDASSICPSTSSLFNLQKSSLSARHPQRKRRGGPSEPTPGSRPQDATVHPACQIFPHYTPSVAYPWSPEAHPLICGPPGLDKRLLPETPGPCYSNSQPVWLCLTPRQPLEPHPPGEGPSEWSSDTAEGRPCPYPHCQVLSAQPGSEEELEELCEQAV

SEQ ID NO: 65 - DNA, 6857 bp, Homo sapiens
gccccctccgagctccccgactcctccccgcgctccacggctcttcccgactccagtcagcgttcctcgggccctcggcgccacaagctgtccgggcacgcagcccctagcggcgcgtcgctgccaagccggcctccgcgcgcctccctccttccttctcccctggctgttcgcgatccagcttgggtaggcggggaagcagctggagtgcgaccgccacggcagccaccctgcaaccgccagtcggaggtgcagtccgtaggccctggcccccgggtgggcccttggggagtcggcgccgctcccgaggagctgcaaggctcgcccctgcccggcgtggagggcgcggggggcgcggaggatattcttggtgatcttggaagtgtccgtatcatggaatcaatctctatgatgggaagccctaagagccttagtgaaactgttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtataccttgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccaaaagctaaaacgaattaaaaaaggctgggaaaagagccaatttctggaagaaggtattggaggaacaattcctcatgtctccccggagagggtcacagtaatgtgatgataaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcctccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcatgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccctacttgagaatcacttgttagttcttggtaggaattcagttgggcaatgataacttttatgggcaaaaacattctattatagtgaacaaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgattt

SEQ ID NO: 66 - protein, 490 aa, Homo sapiens
MESISMMGSPKSLSETVLPNGINGIKDARKVTVGVIGSGDFAKSLTIRLIRCGYHVVIGSRNPKFASEFFPHVVDVTHHEDALTKTNIIFVAIHREHYTSLWDLRHLLVGKILIDVSNNMRINQYPESNAEYLASLFPDSLIVKGFNVVSAWALQLGPKDASRQVYICSNNIQARQQVIELARQLNFIPIDLGSLSSAREIENLPLRLFTLWRGPVVVAISLATFFFLYSFVRDVIHPYARNQQSDFYKIPIEIVNKTLPIVAITLLSLVYLAGLLAAAYQLYYGTKYRRFPPWLETWLQCRKQLGLLSFFFAMVHVAYSLCLPMRRSERYLFLNMAYQQVHANIENSWNEEEVWRIEMYISFGIMSLGLLSLLAVTSIPSVSNALNWREFSFIQSTLGYVALLISTFHVLIYGWKRAFEEEYYRFYTPPNFVLALVLPSIVILGKIILFLPCISQKLKRIKKGWEKSQFLEEGIGGTIPHVSPERVTVM

SEQ ID NO: 67 - DNA, 4103 bp, Homo sapiens
aggctggaaagtggaggatccggtttgctctgggcgggtctggaagcagagccggcggagggagcgccggggccctgggctgcaggaggttgcggcggccgcggcagcatggtggtgccggagaaggagcagagctggatccccaagatcttcaagaagaagacctgcacgacgttcatagttgactccacagatccgggagggaccttgtgccagtgtgggcgcccccggaccgcccaccccgcagtggccatggaggatgccttcggggcagccgtggtgaccgtgtgggacagcgatgcacacaccacggagaagcccaccgatgcctacggagagctggacttcacgggggccggccgcaagcacagcaatttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaaggcctgtgggagctcggaggcctcagcctacctggatgagctgcgtttggctgtggcttggaaccgcgtggacattgcccagagtgaactctttcggggggacatccaatggcggtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaatcgtgaaaaaaa

SEQ ID NO: 68 - protein, 1214 aa, Homo sapiens
MVVPEKEQSWIPKIFKKKTCTTFIVDSTDPGGTLCQCGRPRTAHPAVAMEDAFGAAVVTVWDSDAHTTEKPTDAYGELDFTGAGRKHSNFLRLSDRTDPAAVYSLVTRTWGFRAPNLVVSVLGGSGGPVLQTWLQDLLRRGLVRAAQSTGAWIVTGGLHTGIGRHVGVAVRDHQMASTGGTKVVAMGVAPWGVVRNRDTLINPKGSFPARYRWRGDPEDGVQFPLDYNYSAFFLVDDGTHGCLGGENRFRLRLESYISQQKTGVGGTGIDIPVLLLLIDGDEKMLTRIENATQAQLPCLLVAGSGGAADCLAETLEDTLAPGSGGARQGEARDRIRRFFPKGDLEVLQAQVERIMTRKELLTVYSSEDGSEEFETIVLKALVKACGSSEASAYLDELRLAVAWNRVDIAQSELFRGDIQWRSFHLEASLMDALLNDRPEFVRLLISHGLSLGHFLTPMRLAQLYSAAPSNSLIRNLLDQASHSAGTKAPALKGGAAELRPPDVGHVLRMLLGKMCAPRYPSGGAWDPHPGQGFGESMYLLSDKATSPLSLDAGLGQAPWSDLLLWALLLNRAQMAMYFWEMGSNAVSSALGACLLLRVMARLEPDAEEAARRKDLAFKFEGMGVDLFGECYRSSEVRAARLLLRRCPLWGDATCLQLAMQADARAFFAQDGVQSLLTQKWWGDMASTTPIWALVLAFFCPPLIYTRLITFRKSEEEPTREELEFDMDSVINGEGPVGTADPAEKTPLGVPRQSGRPGCCGGRCGGRRCLRRWFHFWGAPVTIFMGNVVSYLLFLLLFSRVLLVDFQPAPPGSLELLLYFWAFTLLCEELRQGLSGGGGSLASGGPGPGHASLSQRLRLYLADSWNQCDLVALTCFLLGVGCRLTPGLYHLGRTVLCIDFMVFTVRLLHIFTVNKQLGPKIVIVSKMMKDVFFFLFFLGVWLVAYGVATEGLLRPRDSDFPSILRRVFYRPYLQIFGQIPQEDMDVALMEHSNCSSEPGFWAHPPGAQAGTCVSQYANWLVVLLLVIFLLVANILLVNLLIAMFSYTFGKVQGNSDLYWKAQRYRLIREFHSRPALAPPFIVISHLRLLLRQLCRRPRSPQPSSPALEHFRVYLSKEAERKLLTWESVHKENFLLARARDKRESDSERLKRTSQKVDLALKQLGHIREYEQRLKVLEREVQQCSRVLGWVAEALSRSALLPPGGPPPPDLPGSKD

SEQ ID NO: 69 - DNA, 2174 bp, Homo sapiens
aatgatagagatattagggctagttaaccacagttttacaagactcctcttcccgcgtgtgggccattgtcatgctggtgggcgtcccgcccacctgaaaggtctccccgccccgactggggtttgttgttgaagaaggagaatccccggaaaggctgagtctccagctcaaggtcaaaacgtccaaggccgaaagccctccagtttcccctggacgccttgctcctgcttctgctacgaccttctggggaaaacgaatttctcattttcttcttaaattgccattttcgctttaggagatgaatgttttcctttggctgttttggcaatgactctgaattaaagcgatgctaacgcctcttttccccctaattgttaaaagctatggactgcaggaagatggcccgcttctcttacagtgtgatttggatcatggccatttctaaagtctttgaactgggattagttgccgggctgggccatcaggaatttgctcgtccatctcggggatacctggccttcagagatgacagcatttggccccaggaggagcctgcaattcggcctcggtcttcccagcgtgtgccgcccatggggatacagcacagtaaggagctaaacagaacctgctgcctgaatgggggaacctgcatgctggggtccttttgtgcctgccctccctccttctacggacggaactgtgagcacgatgtgcgcaaagagaactgtgggtctgtgccccatgacacctggctgcccaagaagtgttccctgtgtaaatgctggcacggtcagctccgctgctttcctcaggcatttctacccggctgtgatggccttgtgatggatgagcacctcgtggcttccaggactccagaactaccaccgtctgcacgtactaccacttttatgctagttggcatctgcctttctatacaaagctactattaatcgacattgacctatttccagaaatacaattttagatatcatgcaaatttcatgaccagtaaaggctgctgctacaatgtcctaactgaaagatgatcatttgtagttgccttaaaataatgaatacatttccaaaatggtctctaacatttccttacagaactacttcttacttctttgccctgccctctcccaaaaaactacttcttttttcaaaagaaagtcagccatatctccattgtgcctaagtccagtgtttctttttttttttttttttgagacggagtctcactctgtcacccaggctggactgcaatgacgcgatcttggttcactgcaacctccgcatccggggttcaagccattctcctgcctcagcctcccaagtaactgggattacaggcatgtgtcaccatgcccagctaatttttttgtatttttagtagagatgggggtttcaccatattggccagtctggtctcgaactcctgaccttgtgatccactcgcctcagcctctcgaagtgctgagattacacacgtgagcaactgtgcaaggcctggtgtttcttgatacatgtaattctaccaaggtcttcttaatatgttcttttaaatgattgaattatatgttcagattattggagactaattctaatgtggaccttagaatacagttttgagtagagttgatcaaaatcaattaaaatagtctctttaaaaggaaagaaaacatctttaaggggaggaaccagagtgctgaaggaatggaagtccatctgcgtgtgtgcagggagactgggtaggaaagaggaagcaaatagaagagagaggttgaaaaacaaaatgggttacttgattggtgattaggtggtggtagagaagcaagtaaaaaggctaaatggaagggcaagtttccatcatctatagaaagctatataagacaagaactcccctttttttcccaaaggcattataaaaagaatgaagcctccttagaaaaaaaattatacctcaatgtccccaacaagattgcttaataaattgtgtttcctccaagctattcaattcttttaactgttgtagaagacaaaatgttcacaatatatttagttgtaaaccaagtgatcaaactacatattgtaaagcccatttttaaaatacattgtatatatgtgtatgcacagtaaaaatggaaactatattgacctaaaaaaaaaaaaa

SEQ ID NO: 70 - protein, 188 aa, Homo sapiens
MDCRKMARFSYSVIWIMAISKVFELGLVAGLGHQEFARPSRGYLAFRDDSIWPQEEPAIRPRSSQRVPPMGIQHSKELNRTCCLNGGTCMLGSFCACPPSFYGRNCEHDVRKENCGSVPHDTWLPKKCSLCKCWHGQLRCFPQAFLPGCDGLVMDEHLVASRTPELPPSARTTTFMLVGICLSIQSYY

SEQ ID NO: 71 - DNA, 3934 bp, Homo sapiens
gccctcccagagctgccggacgctcgcgggtctcggaacgcatcccgccgcgggggcttcggccgtggcatgggcgccgcgggcctgctcggggttttcttggctctcgtcgcaccgggggtcctcgggatttcttgtggctctcctccgcctatcctaaatggccggattagttattattctacccccattgctgttggtaccgtgataaggtacagttgttcaggtaccttccgcctcattggagaaaaaagtctattatgcataactaaagacaaagtggatggaacctgggataaacctgctcctaaatgtgaatatttcaataaatattcttcttgccctgagcccatagtaccaggaggatacaaaattagaggctctacaccctacagacatggtgattctgtgacatttgcctgtaaaaccaacttctccatgaacggaaacaagtctgtttggtgtcaagcaaataatatgtgggggccgacacgactaccaacctgtgtaagtgttttccctctcgagtgtccagcacttcctatgatccacaatggacatcacacaagtgagaatgttggctccattgctccaggattgtctgtgacttacagctgtgaatctggttacttgcttgttggagaaaagatcattaactgtttgtcttcgggaaaatggagtgctgtcccccccacatgtgaagaggcacgctgtaaatctctaggacgatttcccaatgggaaggtaaaggagcctccaattctccgggttggtgtaactgcaaactttttctgtgatgaagggtatcgactgcaaggcccaccttctagtcggtgtgtaattgctggacagggagttgcttggaccaaaatgccagtatgtgaagaaattttttgcccatcacctccccctattctcaatggaagacatataggcaactcactagcaaatgtctcatatggaagcatagtcacttacacttgtgacccggacccagaggaaggagtgaacttcatccttattggagagagcactctccgttgtacagttgatagtcagaagactgggacctggagtggccctgccccacgctgtgaactttctacttctgcggttcagtgtccacatccccagatcctaagaggccgaatggtatctgggcagaaagatcgatatacctataacgacactgtgatatttgcttgcatgtttggcttcaccttgaagggcagcaagcaaatccgatgcaatgcccaaggcacatgggagccatctgcaccagtctgtgaaaaggaatgccaggcccctcctaacatcctcaatgggcaaaaggaagatagacacatggtccgctttgaccctggaacatctataaaatatagctgtaaccctggctatgtgctggtgggagaagaatccatacagtgtacctctgagggggtgtggacaccccctgtaccccaatgcaaagtggcagcgtgtgaagctacaggaaggcaactcttgacaaaaccccagcaccaatttgttagaccagatgtcaactcttcttgtggtgaagggtacaagttaagtgggagtgtttatcaggagtgtcaaggcacaattccttggtttatggagattcgtctttgtaaagaaatcacctgcccaccaccccctgttatctacaatggggcacacaccgggagttccttagaagattttccatatggaaccacggtcacttacacatgtaaccctgggccagaaagaggagtggaattcagcctcattggagagagcaccatccgttgtacaagcaatgatcaagaaagaggcacctggagtggccctgctcccctatgtaaactttccctccttgctgtccagtgctcacatgtccatattgcaaatggatacaagatatctggcaaggaagccccatatttctacaatgacactgtgacattcaagtgttatagtggatttactttgaagggcagtagtcagattcgttgcaaagctgataacacctgggatcctgaaataccagtttgtgaaaaagaaacatgccagcatgtgagacagagtcttcaagaacttccagctggttcacgtgtggagctagttaatacgtcctgccaagatgggtaccagttgactggacatgcttatcagatgtgtcaagatgctgaaaatggaatttggttcaaaaagattccactttgtaaagttattcactgtcaccctccaccagtgattgtcaatgggaagcacacagggatgatggcagaaaactttctatatggaaatgaagtctcttatgaatgtgaccaaggattctatctcctgggagagaaaaaattgcagtgcagaagtgattctaaaggacatggatcttggagcgggccttccccacagtgcttacgatctcctcctgtgactcgctgccctaatccagaagtcaaacatgggtacaagctcaataaaacacattctgcatattcccacaatgacatagtgtatgttgactgcaatcctggcttcatcatgaatggtagtcgcgtgattaggtgtcatactgataacacatgggtgccaggtgtgccaacttgtatgaaaaaagccttcatagggtgtccacctccgcctaagacccctaacgggaaccatactggtggaaacatagctcgattttctcctggaatgtcaatcctgtacagctgtgaccaaggctacctgctggtgggagaggcactccttctttgcacacatgagggaacctggagccaacctgcccctcattgtaaagaggtaaactgtagctcaccagcagatatggatggaatccagaaagggctggaaccaaggaaaatgtatcagtatggagctgttgtaactctggagtgtgaagatgggtatatgctggaaggcagtccccagagccagtgccaatcggatcaccaatggaaccctcccctggcggtttgcagatcccgttcacttgctcctgtcctttgtggtattgctgcaggtttgatacttcttaccttcttgattgtcattaccttatacgtgatatcaaaacacagagaacgcaattattatacagatacaagccagaaagaagcttttcatttagaagcacgagaagtatattctgttgatccatacaacccagccagctgatcagaagacaaactggtgtgtgcctcattgcttggaattcagcggaatattgattagaaagaaactgctctaatatcagcaagtctctttatatggcctcaagatcaatgaaatgatgtcataagcgatcacttcctatatgcacttattctcaagaagaacatctttatggtaaagatgggagcccagtttcactgccatatactcttcaaggactttctgaagcctcacttatgagatgcctgaagccaggccatggctataaacaattacatggctctaaaaagttttgccctttttaaggaaggcactaaaaagagctgtcctggtatctagacccatcttctttttgaaatcagcatactcaatgttactatctgcttttggttataatgtgtttttaattatctaaagtatgaagcattttctggggttatgatggccttacctttattaggaagtatggttttattttgatagtagcttcctcctctggtggtgttaatcatttcatttttacccttactgtttgagtttctctcacattactgtatatactttgcctttccataatcactcagtgattgcaatttgcacaagtttttttaaattatgggaatcaagatttaatcctagagatttggtgtacaattcaggctttggatgtttctttagcagttttgtgataagttctagttgcttgtaaaatttcacttaataatgtgtacattagtcattcaataaattgtaattgtaaagaaaa

SEQ ID NO: 72 - protein, 1033 aa, Homo sapiens
MGAAGLLGVFLALVAPGVLGISCGSPPPILNGRISYYSTPIAVGTVIRYSCSGTFRLIGEKSLLCITKDKVDGTWDKPAPKCEYFNKYSSCPEPIVPGGYKIRGSTPYRHGDSVTFACKTNFSMNGNKSVWCQANNMWGPTRLPTCVSVFPLECPALPMIHNGHHTSENVGSIAPGLSVTYSCESGYLLVGEKIINCLSSGKWSAVPPTCEEARCKSLGRFPNGKVKEPPILRVGVTANFFCDEGYRLQGPPSSRCVIAGQGVAWTKMPVCEEIFCPSPPPILNGRHIGNSLANVSYGSIVTYTCDPDPEEGVNFILIGESTLRCTVDSQKTGTWSGPAPRCELSTSAVQCPHPQILRGRMVSGQKDRYTYNDTVIFACMFGFTLKGSKQIRCNAQGTWEPSAPVCEKECQAPPNILNGQKEDRHMVRFDPGTSIKYSCNPGYVLVGEESIQCTSEGVWTPPVPQCKVAACEATGRQLLTKPQHQFVRPDVNSSCGEGYKLSGSVYQECQGTIPWFMEIRLCKEITCPPPPVIYNGAHTGSSLEDFPYGTTVTYTCNPGPERGVEFSLIGESTIRCTSNDQERGTWSGPAPLCKLSLLAVQCSHVHIANGYKISGKEAPYFYNDTVTFKCYSGFTLKGSSQIRCKADNTWDPEIPVCEKETCQHVRQSLQELPAGSRVELVNTSCQDGYQLTGHAYQMCQDAENGIWFKKIPLCKVIHCHPPPVIVNGKHTGMMAENFLYGNEVSYECDQGFYLLGEKKLQCRSDSKGHGSWSGPSPQCLRSPPVTRCPNPEVKHGYKLNKTHSAYSHNDIVYVDCNPGFIMNGSRVIRCHTDNTWVPGVPTCMKKAFIGCPPPPKTPNGNHTGGNIARFSPGMSILYSCDQGYLLVGEALLLCTHEGTWSQPAPHCKEVNCSSPADMDGIQKGLEPRKMYQYGAVVTLECEDGYMLEGSPQSQCQSDHQWNPPLAVCRSRSLAPVLCGIAAGLILLTFLIVITLYVISKHRERNYYTDTSQKEAFHLEAREVYSVDPYNPAS

SEQ ID NO: 73 - DNA, 1300 bp, Homo sapiens
ctgcagccggtgcagttacacgttttcctccaaggagcctcggacgttgtcacgggtttggggtcggggacagagcggtgaccatggccaggctggcgttgtctcctgtgcccagccactggatggtggcgttgctgctgctgctctcagctgagccagtaccagcagccagatcggaggaccggtaccggaatcccaaaggtagtgcttgttcgcggatctggcagagcccacgtttcatagccaggaaacggggcttcacggtgaaaatgcactgctacatgaacagcgcctccggcaatgtgagctggctctggaagcaggagatggacgagaatccccagcagctgaagctggaaaagggccgcatggaagagtcccagaacgaatctctcgccaccctcaccatccaaggcatccggtttgaggacaatggcatctacttctgtcagcagaagtgcaacaacacctcggaggtctaccagggctgcggcacagagctgcgagtcatgggattcagcaccttggcacagctgaagcagaggaacacgctgaaggatggtatcatcatgatccagacgctgctgatcatcctcttcatcatcgtgcctatcttcctgctgctggacaaggatgacagcaaggctggcatggaggaagatcacacctacgagggcctggacattgaccagacagccacctatgaggacatagtgacgctgcggacaggggaagtgaagtggtctgtaggtgagcacccaggccaggagtgagagccaggtcgccccatgacctgggtgcaggctccctggcctcagtgactgcttcggagctgcctggctcatggcccaacccctttcctggaccccccagctggcctctgaagctggcccaccagagctgccatttgtctccagcccctggtccccagctcttgccaaagggcctggagtagaaggacaacagggcagcaacttggagggagttctctggggatggacgggacccagccttctgggggtgctatgaggtgatccgtccccacacatgggatgggggaggcagagactggtccagagcccgcaaatggactcggagccgagggcctcccagcagagcttgggaagggccatggacccaactgggccccagaagagccacaggaacatcattcctctcccgcaaccactcccaccccagggaggccctggcctccagtgccttcccccgtggaataaacggtgtgtcctgagaaaccacaaaaaaaaaaaaaaaaaaaaaaaaaaaaaaaaaaaaaaaa

SEQ ID NO: 74 - protein, 229 aa, Homo sapiens
MARLALSPVPSHWMVALLLLLSAEPVPAARSEDRYRNPKGSACSRIWQSPRFIARKRGFTVKMHCYMNSASGNVSWLWKQEMDENPQQLKLEKGRMEESQNESLATLTIQGIRFEDNGIYFCQQKCNNTSEVYQGCGTELRVMGFSTLAQLKQRNTLKDGIIMIQTLLIILFIIVPIFLLLDKDDSKAGMEEDHTYEGLDIDQTATYEDIVTLRTGEVKWSVGEHPGQE

SEQ ID NO: 75 - DNA, 2592 bp, Homo sapiens
agagtctccagttggtgaccaagagtacatctcttttcaaatagctggattaggtcctcatgctgctgtggtcattgctggtcatctttgatgcagtcactgaacaggcagattcgctgacccttgtggcgccctcttctgtcttcgaaggagacagcatcgttctgaaatgccagggagaacagaactggaaaattcagaagatggcttaccataaggataacaaagagttatctgttttcaaaaaattctcagatttccttatccaaagtgcagttttaagtgacagtggtaactatttctgtagtaccaaaggacaactctttctctgggataaaacttcaaatatagtaaagataaaagtccaagagctctttcaacgtcctgtgctgactgccagctccttccagcccatcgaagggggtccagtgagcctgaaatgtgagacccggctctctccacagaggttggatgttcaactccagttctgcttcttcagagaaaaccaggtcctggggtcaggctggagcagctctccggagctccagatttctgccgtgtggagtgaagacacagggtcttactggtgcaaggcagaaacggtgactcacaggatcagaaaacagagcctccaatcccagattcacgtgcagagaatccccatctctaatgtaagcttggagatccgggcccccgggggacaggtgactgaaggacaaaaactgatcctgctctgctcagtggctgggggtacaggaaatgtcacattctcctggtacagagaggccacaggaaccagtatgggaaagaaaacccagcgttccctgtcagcagagctggagatcccagctgtgaaagagagtgatgccggcaaatattactgtagagctgacaacggccatgtgcctatccagagcaaggtggtgaatatccctgtgagaattccagtgtctcgccctgtcctcaccctcaggtctcctggggcccaggctgcagtgggggacctgctggagcttcactgtgaggccctgagaggctctcccccaatcttgtaccaattttatcatgaggatgtcacccttgggaacagctcggccccctctggaggaggggcctccttcaacctctctttgactgcagaacattctggaaactactcctgtgaggccaacaacggcctgggggcccagtgcagtgaggcagtgccagtctccatctcaggacctgatggctatagaagagacctcatgacagctggagttctctggggactgtttggtgtccttggtttcactggtgttgctttgctgttgtatgccttgttccacaagatatcaggagaaagttctgccactaatgaacccagaggggcttccaggccaaatcctcaagagttcacctattcaagcccaaccccagacatggaggagctgcagccagtgtatgtcaatgtgggctctgtagatgtggatgtggtttattctcaggtctggagcatgcagcagccagaaagctcagcaaacatcaggacacttctggagaacaaggactcccaagtcatctactcttctgtgaagaaatcataacacttggaggaatcagaagggaagatcaacagcaaggatggggcatcattaagacttgctataaaaccttatgaaaatgcttgaggcttatcacctgccacagccagaacgtgcctcaggaggcacctcctgtcatttttgtcctgatgatgtttcttctccaatatcttcttttacctatcaatattcattgaactgctgctacatccagacactgtgcaaataaattatttctgctaccttctcttaagcaatcagtgtgtaaagatttgagggaagaatgaataagagatacaaggtctcaccttcatctactgtgaagtgatgagaacaggacttgatagtggtgtattaacttatttatgtgctgctggatacagtttgctaatattttgttgagaatttttgcaaatatgttcattgggaatattggcctgaaattttcttttccactgtgtctctgccagaatgtttgtatcaggctgatgctggcttcatagaatgagttaggcaggagcccttcctccttgattttttggcatagtttcagcaggattggtaccagttattctttctgcatcttgtagaattcagctatgaatccatctggtctagggcttttgtgttggttggtaagttttttattactaattcaacttcagcgcttgatattggtctaggaggggtttctgtctcttcctggttcaatcttgggagattgtgtgtttccaggaatttagccgtttcctccagattttcttctttatgtgcatcgacttgagtgtaaacataacttatatgcactgggaaaccaaaaaatctgtgtgacttgctttattgcagcatttgttttattttggtagtctggaactgaacctgcaatatcaccaaagtatgcatatagttgcaaaaatgtgatttttgacatagtaaatatgagtatttgcaataaactatgatattacttttgtaagtatatagaataaaatgtaaataatctataaaa

SEQ ID NO: 76 - protein, 508 aa, Homo sapiens
MLLWSLLVIFDAVTEQADSLTLVAPSSVFEGDSIVLKCQGEQNWKIQKMAYHKDNKELSVFKKFSDFLIQSAVLSDSGNYFCSTKGQLFLWDKTSNIVKIKVQELFQRPVLTASSFQPIEGGPVSLKCETRLSPQRLDVQLQFCFFRENQVLGSGWSSSPELQISAVWSEDTGSYWCKAETVTHRIRKQSLQSQIHVQRIPISNVSLEIRAPGGQVTEGQKLILLCSVAGGTGNVTFSWYREATGTSMGKKTQRSLSAELEIPAVKESDAGKYYCRADNGHVPIQSKVVNIPVRIPVSRPVLTLRSPGAQAAVGDLLELHCEALRGSPPILYQFYHEDVTLGNSSAPSGGGASFNLSLTAEHSGNYSCEANNGLGAQCSEAVPVSISGPDGYRRDLMTAGVLWGLFGVLGFTGVALLLYALFHKISGESSATNEPRGASRPNPQEFTYSSPTPDMEELQPVYVNVGSVDVDVVYSQVWSMQQPESSANIRTLLENKDSQVIYSSVKKS

SEQ ID NO: 77 - DNA, 4530 bp, Homo sapiens
aattctcgagctcgtcgaccggtcgacgagctcgagggtcgacgagctcgagggcgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaagtgtgcaccggcacagacatgaagctgcggctccctgccagtcccgagacccacctggacatgctccgccacctctaccagggctgccaggtggtgcagggaaacctggaactcacctacctgcccaccaatgccagcctgtccttcctgcaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacagagatcttgaaaggaggggtcttgatccagcggaacccccagctctgctaccaggacacgattttgtggaaggacatcttccacaagaacaaccagctggctctcacactgatagacaccaaccgctctcgggcctgccacccctgttctccgatgtgtaagggctcccgctgctggggagagagttctgaggattgtcagagcctgacgcgcactgtctgtgccggtggctgtgcccgctgcaaggggccactgcccactgactgctgccatgagcagtgtgctgccggctgcacgggccccaagcactctgactgcctggcctgcctccacttcaaccacagtggcatctgtgagctgcactgcccagccctggtcacctacaacacagacacgtttgagtccatgcccaatcccgagggccggtatacattcggcgccagctgtgtgactgcctgtccctacaactacctttctacggacgtgggatcctgcaccctcgtctgccccctgcacaaccaagaggtgacagcagaggatggaacacagcggtgtgagaagtgcagcaagccctgtgcccgagtgtgctatggtctgggcatggagcacttgcgagaggtgagggcagttaccagtgccaatatccaggagtttgctggctgcaagaagatctttgggagcctggcatttctgccggagagctttgatggggacccagcctccaacactgccccgctccagccagagcagctccaagtgtttgagactctggaagagatcacaggttacctatacatctcagcatggccggacagcctgcctgacctcagcgtcttccagaacctgcaagtaatccggggacgaattctgcacaatggcgcctactcgctgaccctgcaagggctgggcatcagctggctggggctgcgctcactgagggaactgggcagtggactggccctcatccaccataacacccacctctgcttcgtgcacacggtgccctgggaccagctctttcggaacccgcaccaagctctgctccacactgccaaccggccagaggacgagtgtgtgggcgagggcctggcctgccaccagctgtgcgcccgagggcactgctggggtccagggcccacccagtgtgtcaactgcagccagttccttcggggccaggagtgcgtggaggaatgccgagtactgcaggggctccccagggagtatgtgaatgccaggcactgtttgccgtgccaccctgagtgtcagccccagaatggctcagtgacctgttttggaccggaggctgaccagtgtgtggcctgtgcccactataaggaccctcccttctgcgtggcccgctgccccagcggtgtgaaacctgacctctcctacatgcccatctggaagtttccagatgaggagggcgcatgccagccttgccccatcaactgcacccactcctgtgtggacctggatgacaagggctgccccgccgagcagagagccagccctctgacgtccatcgtctctgcggtggttggcattctgctggtcgtggtcttgggggtggtctttgggatcctcatcaagcgacggcagcagaagatccggaagtacacgatgcggagactgctgcaggaaacggagctggtggagccgctgacacctagcggagcgatgcccaaccaggcgcagatgcggatcctgaaagagacggagctgaggaaggtgaaggtgcttggatctggcgcttttggcacagtctacaagggcatctggatccctgatggggagaatgtgaaaattccagtggccatcaaagtgttgagggaaaacacatcccccaaagccaacaaagaaatcttagacgaagcatacgtgatggctggtgtgggctccccatatgtctcccgccttctgggcatctgcctgacatccacggtgcagctggtgacacagcttatgccctatggctgcctcttagaccatgtccgggaaaaccgcggacgcctgggctcccaggacctgctgaactggtgtatgcagattgccaaggggatgagctacctggaggatgtgcggctcgtacacagggacttggccgctcggaacgtgctggtcaagagtcccaaccatgtcaaaattacagacttcgggctggctcggctgctggacattgacgagacagagtaccatgcagatgggggcaaggtgcccatcaagtggatggcgctggagtccattctccgccggcggttcacccaccagagtgatgtgtggagttatggtgtgactgtgtgggagctgatgacttttggggccaaaccttacgatgggatcccagcccgggagatccctgacctgctggaaaagggggagcggctgccccagccccccatctgcaccattgatgtctacatgatcatggtcaaatgttggatgattgactctgaatgtcggccaagattccgggagttggtgtctgaattctcccgcatggccagggacccccagcgctttgtggtcatccagaatgaggacttgggcccagccagtcccttggacagcaccttctaccgctcactgctggaggacgatgacatgggggacctggtggatgctgaggagtatctggtaccccagcagggcttcttctgtccagaccctgccccgggcgctgggggcatggtccaccacaggcaccgcagctcatctaccaggagtggcggtggggacctgacactagggctggagccctctgaagaggaggcccccaggtctccactggcaccctccgaaggggctggctccgatgtatttgatggtgacctgggaatgggggcagccaaggggctgcaaagcctccccacacatgaccccagccctctacagcggtacagtgaggaccccacagtacccctgccctctgagactgatggctacgttgcccccctgacctgcagcccccagcctgaatatgtgaaccagccagatgttcggccccagcccccttcgccccgagagggccctctgcctgctgcccgacctgctggtgccactctggaaagggccaagactctctccccagggaagaatggggtcgtcaaagacgtttttgcctttgggggtgccgtggagaaccccgagtacttgacaccccagggaggagctgcccctcagccccaccctcctcctgccttcagcccagccttcgacaacctctattactgggaccaggacccaccagagcggggggctccacccagcaccttcaaagggacacctacggcagagaacccagagtacctgggtctggacgtgccagtgtgaaccagaaggccaagtccgcagaagccctgatgtgtcctcagggagcagggaaggcctgacttctgctggcatcaagaggtgggagggccctccgaccacttccaggggaacctgccatgccaggaacctgtcctaaggaaccttccttcctgcttgagttcccagatggctggaaggggtccagcctcgttggaagaggaacagcactggggagtctttgtggattctgaggccctgcccaatgagactctagggtccagtggatgccacagcccagcttggccctttccttccagatcctgggtactgaaagccttagggaagctggcctgagaggggaagcggccctaagggagtgtctaagaacaaaagcgacccattcagagactgtccctgaaacctagtactgccccccatgaggaaggaacagcaatggtgtcagtatccaggctttgtacagagtgcttttctgtttagtttttactttttttgttttgtttttttaaagacgaaataaagacccaggggagaatgggtgttgtatggggaggcaagtgtggggggtccttctccacacccactttgtccatttgcaaatatattttggaaaac

SEQ ID NO: 78 - protein, 1255 aa, Homo sapiens
MELAALCRWGLLLALLPPGAASTQVCTGTDMKLRLPASPETHLDMLRHLYQGCQVVQGNLELTYLPTNASLSFLQDIQEVQGYVLIAHNQVRQVPLQRLRIVRGTQLFEDNYALAVLDNGDPLNNTTPVTGASPGGLRELQLRSLTEILKGGVLIQRNPQLCYQDTILWKDIFHKNNQLALTLIDTNRSRACHPCSPMCKGSRCWGESSEDCQSLTRTVCAGGCARCKGPLPTDCCHEQCAAGCTGPKHSDCLACLHFNHSGICELHCPALVTYNTDTFESMPNPEGRYTFGASCVTACPYNYLSTDVGSCTLVCPLHNQEVTAEDGTQRCEKCSKPCARVCYGLGMEHLREVRAVTSANIQEFAGCKKIFGSLAFLPESFDGDPASNTAPLQPEQLQVFETLEEITGYLYISAWPDSLPDLSVFQNLQVIRGRILHNGAYSLTLQGLGISWLGLRSLRELGSGLALIHHNTHLCFVHTVPWDQLFRNPHQALLHTANRPEDECVGEGLACHQLCARGHCWGPGPTQCVNCSQFLRGQECVEECRVLQGLPREYVNARHCLPCHPECQPQNGSVTCFGPEADQCVACAHYKDPPFCVARCPSGVKPDLSYMPIWKFPDEEGACQPCPINCTHSCVDLDDKGCPAEQRASPLTSIVSAVVGILLVVVLGVVFGILIKRRQQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVRENRGRLGSQDLLNWCMQIAKGMSYLEDVRLVHRDLAARNVLVKSPNHVKITDFGLARLLDIDETEYHADGGKVPIKWMALESILRRRFTHQSDVWSYGVTVWELMTFGAKPYDGIPAREIPDLLEKGERLPQPPICTIDVYMIMVKCWMIDSECRPRFRELVSEFSRMARDPQRFVVIQNEDLGPASPLDSTFYRSLLEDDDMGDLVDAEEYLVPQQGFFCPDPAPGAGGMVHHRHRSSSTRSGGGDLTLGLEPSEEEAPRSPLAPSEGAGSDVFDGDLGMGAAKGLQSLPTHDPSPLQRYSEDPTVPLPSETDGYVAPLTCSPQPEYVNQPDVRPQPPSPREGPLPAARPAGATLERAKTLSPGKNGVVKDVFAFGGAVENPEYLTPQGGAAPQPHPPPAFSPAFDNLYYWDQDPPERGAPPSTFKGTPTAENPEYLGLDVPV

SEQ ID NO: 79 - DNA, 2533 bp, Homo sapiens
ggagctcaagctcctctacaaagaggtggacagagaagacagcagagaccatgggacccccctcagcccctccctgcagattgcatgtcccctggaaggaggtcctgctcacagcctcacttctaaccttctggaacccacccaccactgccaagctcactattgaatccacgccattcaatgtcgcagaggggaaggaggttcttctactcgcccacaacctgccccagaatcgtattggttacagctggtacaaaggcgaaagagtggatggcaacagtctaattgtaggatatgtaataggaactcaacaagctaccccagggcccgcatacagtggtcgagagacaatataccccaatgcatccctgctgatccagaacgtcacccagaatgacacaggattctataccctacaagtcataaagtcagatcttgtgaatgaagaagcaaccggacagttccatgtatacccggagctgcccaagccctccatctccagcaacaactccaaccccgtggaggacaaggatgctgtggccttcacctgtgaacctgaggttcagaacacaacctacctgtggtgggtaaatggtcagagcctcccggtcagtcccaggctgcagctgtccaatggcaacatgaccctcactctactcagcgtcaaaaggaacgatgcaggatcctatgaatgtgaaatacagaacccagcgagtgccaaccgcagtgacccagtcaccctgaatgtcctctatggcccagatgtccccaccatttccccctcaaaggccaattaccgtccaggggaaaatctgaacctctcctgccacgcagcctctaacccacctgcacagtactcttggtttatcaatgggacgttccagcaatccacacaagagctctttatccccaacatcactgtgaataatagcggatcctatatgtgccaagcccataactcagccactggcctcaataggaccacagtcacgatgatcacagtctctggaagtgctcctgtcctctcagctgtggccaccgtcggcatcacgattggagtgctggccagggtggctctgatatagcagccctggtgtattttcgatatttcaggaagactggcagattggaccagaccctgaattcttctagctcctccaatcccattttatcccatggaaccactaaaaacaaggtctgctctgctcctgaagccctatatgctggagatggacaactcaatgaaaatttaaagggaaaaccctcaggcctgaggtgtgtgccactcagagacttcacctaactagagacagtcaaactgcaaaccatggtgagaaattgacgacttcacactatggacagcttttcccaagatgtcaaaacaagactcctcatcatgataaggctcttacccccttttaatttgtccttgcttatgcctgcctctttcgcttggcaggatgatgctgtcattagtatttcacaagaagtagcttcagagggtaacttaacagagtgtcagatctatcttgtcaatcccaacgttttacataaaataagagatcctttagtgcacccagtgactgacattagcagcatctttaacacagccgtgtgttcaaatgtacagtggtccttttcagagttggacttctagactcacctgttctcactccctgttttaattcaacccagccatgcaatgccaaataatagaattgctccctaccagctgaacagggaggagtctgtgcagtttctgacacttgttgttgaacatggctaaatacaatgggtatcgctgagactaagttgtagaaattaacaaatgtgctgcttggttaaaatggctacactcatctgactcattctttattctattttagttggtttgtatcttgcctaaggtgcgtagtccaactcttggtattaccctcctaatagtcatactagtagtcatactccctggtgtagtgtattctctaaaagctttaaatgtctgcatgcagccagccatcaaatagtgaatggtctctctttggctggaattacaaaactcagagaaatgtgtcatcaggagaacatcataacccatgaaggataaaagccccaaatggtggtaactgataatagcactaatgctttaagatttggtcacactctcacctaggtgagcgcattgagccagtggtgctaaatgctacatactccaactgaaatgttaaggaagaagatagatccaattaaaaaaaattaaaaccaatttaaaaaaaaaaaagaacacaggagattccagtctacttgagttagcataatacagaagtcccctctactttaacttttacaaaaaagtaacctgaactaatctgatgttaaccaatgtatttatttctgtggttctgtttccttgttccaatttgacaaaacccactgttcttgtattgtattgcccagggggagctatcactgtacttgtagagtggtgctgctttaattcataaatcacaaataaaagccaattagctctataact

SEQ ID NO: 80 - protein, 344 aa, Homo sapiens
MGPPSAPPCRLHVPWKEVLLTASLLTFWNPPTTAKLTIESTPFNVAEGKEVLLLAHNLPQNRIGYSWYKGERVDGNSLIVGYVIGTQQATPGPAYSGRETIYPNASLLIQNVTQNDTGFYTLQVIKSDLVNEEATGQFHVYPELPKPSISSNNSNPVEDKDAVAFTCEPEVQNTTYLWWVNGQSLPVSPRLQLSNGNMTLTLLSVKRNDAGSYECEIQNPASANRSDPVTLNVLYGPDVPTISPSKANYRPGENLNLSCHAASNPPAQYSWFINGTFQQSTQELFIPNITVNNSGSYMCQAHNSATGLNRTTVTMITVSGSAPVLSAVATVGITIGVLARVALI

SEQ ID NO: 81 - DNA, 1583 bp, Homo sapiens
gtgcctctcctggcaggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctgggctgacaactggctggtggacacgggagacagcgagccccagagccaaggcttgtcaccctttgggcagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtgaaacagacagacagcctggtgatggtgaacttctacaacaattacatttcctgcaccaacaaggccaacctgtcccaagtggccgaccatctggatcacatcaaggaggtggcaggagccagagccgtgggttttggtggggactttgatggtgttccaagggtccctgaggggctggaggacgtctccaagtatccagacctgatcgctgagctgctcaggaggaactggacggaggcggaggtcaagggcgcactggctgacaacctgctgagggtcttcgaggctgtggaacaggccagcaacctcacacaggctcccgaggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggactccagatgccaggagccctgctgcccacatgcaaggaccagcatctcctgagaggacgcctgggcttacctggggggcaggatgcctggggacagttcaggacacacacacagtaggcccgcaataaaagcaacaccccttcaaaaaaaaaaaaaaaaa

SEQ ID NO: 82 - protein, 411 aa, Homo sapiens
MWSGWWLWPLVAVCTADFFRDEAERIMRDSPVIDGHNDLPWQLLDMFNNRLQDERANLTTLAGTHTNIPKLRAGFVGGQFWSVYTPCDTQNKDAVRRTLEQMDVVHRMCRMYPETFLYVTSSAGIRQAFREGKVASLIGVEGGHSIDSSLGVLRALYQLGMRYLTLTHSCNTPWADNWLVDTGDSEPQSQGLSPFGQRVVKELNRLGVLIDLAHVSVATMKATLQLSRAPVIFSHSSAYSVCASRRNVPDDVLRLVKQTDSLVMVNFYNNYISCTNKANLSQVADHLDHIKEVAGARAVGFGGDFDGVPRVPEGLEDVSKYPDLIAELLRRNWTEAEVKGALADNLLRVFEAVEQASNLTQAPEEEPIPLDQLGGSCRTHYGYSSGASSLHRHWGLLLASLAPLVLCLSLL

SEQ ID NO: 83 - DNA, 3485 bp, Homo sapiens
tccagctgggtagccgggggagcgcgcgtgggggctccgcgagtcgctcgcccttggtttctggggaagcctgggggacgcggctgtggcggaggcgccctgggactcaggtcgcctggagcgtggcacgcagagccccaggcgcggagctgaggccgcgcggccgcgcttggccccagcgggcgtgggactgagcagtctgctgccccccgacatgtgacccagccccgccgcccatgcgggctcccggccgcccggccctgcggccgctgccgctgccgccgctgctgctgttgctcctggcggcgccttggggacgggcagttccctgtgtctctggtggtttgcctaaacctgcaaacatcaccttcttatccatcaacatgaagaatgtcctacaatggactccaccagagggtcttcaaggagttaaagttacttacactgtgcagtatttcatatatgggcaaaagaaatggctgaataaatcagaatgcagaaatatcaatagaacctactgtgatctttctgctgaaacttctgactacgaacaccagtattatgccaaagttaaggccatttggggaacaaagtgttccaaatgggctgaaagtggacggttctatccttttttagaaacacaaattggcccaccagaggtggcactgactacagatgagaagtccatttctgttgtcctgacagctccagagaagtggaagagaaatccagaagaccttcctgtttccatgcaacaaatatactccaatctgaagtataacgtgtctgtgttgaatactaaatcaaacagaacgtggtcccagtgtgtgaccaaccacacgctggtgctcacctggctggagccgaacactctttactgcgtacacgtggagtccttcgtcccagggccccctcgccgtgctcagccttctgagaagcagtgtgccaggactttgaaagatcaatcatcagagttcaaggctaaaatcatcttctggtatgttttgcccatatctattaccgtgtttcttttttctgtgatgggctattccatctaccgatatatccacgttggcaaagagaaacacccagcaaatttgattttgatttatggaaatgaatttgacaaaagattctttgtgcctgctgaaaaaatcgtgattaactttatcaccctcaatatctcggatgattctaaaatttctcatcaggatatgagtttactgggaaaaagcagtgatgtatccagccttaatgatcctcagcccagcgggaacctgaggccccctcaggaggaagaggaggtgaaacatttagggtatgcttcgcatttgatggaaattttttgtgactctgaagaaaacacggaaggtacttctttcacccagcaagagtccctcagcagaacaatacccccggataaaacagtcattgaatatgaatatgatgtcagaaccactgacatttgtgcggggcctgaagagcaggagctcagtttgcaggaggaggtgtccacacaaggaacattattggagtcgcaggcagcgttggcagtcttgggcccgcaaacgttacagtactcatacacccctcagctccaagacttagaccccctggcgcaggagcacacagactcggaggaggggccggaggaagagccatcgacgaccctggtcgactgggatccccaaactggcaggctgtgtattccttcgctgtccagcttcgaccaggattcagagggctgcgagccttctgagggggatgggctcggagaggagggtcttctatctagactctatgaggagccggctccagacaggccaccaggagaaaatgaaacctatctcatgcaattcatggaggaatgggggttatatgtgcagatggaaaactgatgccaacacttccttttgccttttgtttcctgtgcaaacaagtgagtcacccctttgatcccagccataaagtacctgggatgaaagaagttttttccagtttgtcagtgtctgtgagaattacttatttcttttctctattctcatagcacgtgtgtgattggttcatgcatgtaggtctcttaacaatgatggtgggcctctggagtccaggggctggccggttgttctatgcagagaaagcagtcaataaatgtttgccagactgggtgcagaatttattcaggtgggtgtactctggcctcttggttcattattttcaaacaagcacacttgtacaattattttctgggtacttcccatatgcacatagcactgtaaaaaatatttcccaaagatcactcattttataaataccactttttcagaattgggtttattgcgagcaggaggagatacttaaaacatgcacatataccaggttggtggtaagttggtcacatgtgaaaacctcaactatttaatcatcatgattcatattttgagtgaatacatcaggcacagaccttcatgatatcacacactcttggctactttaagaggccatctttaatactttatgagtagttctggagtgtaaacataaacgagtattcttttgtagtcagaaaagtgtcctctcaataatttagtaggggcttattgtctctcaaaactaacctaaaagaaaatgacacattttataatagaatattacatttatttctggaagtgtgttttcaaaaagatatttacatagtctgtaaactagaaagtgttaggtaaagctctaggttactgtgttactattataatattaaacattcgaataggcagtcgttcaaagactctttggaatatctatgaatgaatatcctctattcttataatattaaaacccataagtaaatataggacatacaagagaaatgagttaaatgactatgtaagggagagtttattaaaatttgatgaaatttactgtaggaactaaactatgccataaaacaatagctttctagttcatttccagtaactgttcccatctcctttaccacttgttaagaaaattaaattcttcagtcacgctgctttaaaatgggacaaaatctattaagttgaaccatatataattgtggatatttggctgtttttaatctgacaagcagtaacttcatatggtttgccttaatatatatttgttttagtcatgaactcataatccattgatgctctttcatgagaagagatatgacccatatttccttattgatattattggtacaggcagacaaccctggtaggagagatggattctggggtcatgacctttcgtgattatccgcaaatgcaaacagtttcagatctaatggtttaatttagggagtaattatattaatcagagtgttctgttattctcaatctttatagaaacgattctgctggttttgaagaacagatgtattacactaactgtaaaagtagttcaagagtgagaaagaataaattgttattaagagcaaaagaaaaataaagtgattgatgata

SEQ ID NO: 84 - protein, 553 aa, Homo sapiens [sequence omitted]

SEQ ID NO: 85 - DNA, 2558 bp, Homo sapiens
tgtggcactgcctgcgtacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaattgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaattctgcccaaggctcaactgccctctctatcctactccttttcttccccctgcagctctgggtcacctgacctgtagtcctttaacccaccatcatcccaaactctcctgtcctttgccttcattctcttacccacctctacctatgggtctccaatctcggatatccaccttgtgggtatctcagctctccgcgtctttaccctgtgatcccagccccgccactgaccatctgtgacccttccctgccattgggccctccacctgtggctcacatctcgccagccccacagagcatcctcaggcctctccaagggtcctcatcacctattgcagccttcagggctcggcctattttccactactcccttcatccgcctgtgtgccgtcccctttagctgcctcctattgatctcagggaagcctgggagtcccttctcacccctcaacctccggagtccaggagaacccgtacccccacagagccttaagcaactacttctgtgaagtattttttgactgtttcatggaaaacaagccttggaaataaatctctattaaaccgc

SEQ ID NO: 86 - protein, 671 aa, Homo sapiens
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGNSAQGSTALSILLLFFPLQLWVT

SEQ ID NO: 87 - DNA, 4869 bp, Homo sapiens
cattctgctggctgcgcggtggcggcggctgtgtgtgcgccgcgccttgccgccccccctggccccccgagcccggggcgcgcgctcccgcccgggccgtccgggccccgcggcgccgcggcccgaggccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagaagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttcctaccttttgaggacttgatccttctccaggaagaaggtgctttctgcttactgacttaggcaatacaccaagggcgagattttatatgcacatttctggatttttttatacggttttcattgacactcttccctcctcccacctgccaccaggcctcaccaaagcccactgccatggggccatctgggccattcagagactggagtgagatttgggtgtggagggggaggcgccaaggtggaggagcttcccactccaggactgttgatgaaagggacagattgaggaggaagtgggctctgaggctgcagggctggaagtccttgcccacttcccactctcctgccccaatctatctagtacttcccaggcaaataggcccctttgaggctcctgagtgccctcagatggtcaaaacccagttttccctctgggagcctaaaccaggctgcatcggaggccaggacccggatcattcactgtgataccctgccctccagagggtgcgctcagagacacgggcaagcatgcctcttcccttccctggagagaaagtgtgtgatttctctcccacctccttccccccaccagacctttgctgggcctaaaggtcttggccatggggacgccctcagtctagggatctggccacagactccctcctgtgaaccaacacagacacccaagcagagcaatcagttagtgaattgaatggaaataaacgctttagttataatatga

SEQ ID NO: 88 - protein, 987 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEV

SEQ ID NO: 89 - DNA, 1658 bp, Homo sapiens
ggaaggcagcggcagctccactcagccagtacccagatacgctgggaaccttccccagccatggcttccctggggcagatcctcttctggagcataattagcatcatcattattctggctggagcaattgcactcatcattggctttggtatttcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgccttggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagacaagtgtgttaagagtgataagtaaaatgcacgtggagacaagtgcatccccagatctcagggacctccccctgcctgtcacctggggagtgagaggacaggatagtgcatgttctttgtctctgaatttttagttatatgtgctgtaatgttgctctgaggaagcccctggaaagtctatcccaacatatccacatcttatattccacaaattaagctgtagtatgtaccctaagacgctgctaattgactgccacttcgcaactcaggggcggctgcattttagtaatgggtcaaatgattcactttttatgatgcttccaaaggtgccttggcttctcttcccaactgacaaatgccaaagttgagaaaaatgatcataattttagcataaacagagcagtcggggacaccgattttataaataaactgagcaccttctttttaaacaaaaaaaaaaaaaaaaaaaaaaaaaaaaaaaaaaaaaaaaaaaaaaaaaaaa

SEQ ID NO: 90 - DNA, 946 bp, Homo sapiens
tgacagcccaccagtgaccatgaaggctgtgctgcttgccctgttgatggcaggcttggccctgcagccaggcactgccctgctgtgctactcctgcaaagcccaggtgagcaacgaggactgcctgcaggtggagaactgcacccagctgggggagcagtgctggaccgcgcgcatccgcgcagttggcctcctgaccgtcatcagcaaaggctgcagcttgaactgcgtggatgactcacaggactactacgtgggcaagaagaacatcacgtgctgtgacaccgacttgtgcaacgccagcggggcccatgccctgcagccggctgccgccatccttgcgctgctccctgcactcggcctgctgctctggggacccggccagctataggctctggggggccccgctgcagcccacactgggtgtggtgccccaggcctctgtgccactcctcacagacctggcccagtgggagcctgtcctggttcctgaggcacatcctaacgcaagtctgaccatgtatgtttgcacccctgtcccccaccctgaccctcccatggccctctccaggactcccacccggcagatcagctctagtgacacagatccgcctgcagatggcccctccaaccctctctgctgctgtttccatggcccagcattctccacccttaaccctgtgctcaggcacctcttcccccaggaagccttccctgcccaccccatctatgacttgagccaggtctggtccgtggtgtcccccgcacccagcaggggacaggcactcaggagggcccagtaaaggctgagatgaagtggactgagtagaactggaggacaagagtcgacgtgagttcctgggagtctccagagatggggcctggaggcctggaggaaggggccaggcctcacattcgtggggctccctgaatggcagcctgagca

SEQ ID NO: 91 - protein, 123 aa, Homo sapiens
MKAVLLALLMAGLALQPGTALLCYSCKAQVSNEDCLQVENCTQLGEQCWTARIRAVGLLTVISKGCSLNCVDDSQDYYVGKKNITCCDTDLCNASGAHALQPAAAILALLPALGLLLWGPGQL

SEQ ID NO: 92 - DNA, 1852 bp, Homo sapiens
ctgggctgaggcggaggcaggggagttgcagcgcgcgaggctccgtgagtgtgtctcctgcgcgctgagaggcggggggaggcggaggaccaggaggaggaggaggaggaggaggagggggagaatgcccggagccgccgccgctgccgccgccgccgccgccgcgatgctcccggctcaggaggctgccaagctgtaccacaccaactatgtgcggaactcgcgggccatcggcgtgctgtgggccatcttcaccatctgctttgccatcgtcaacgtggtgtgcttcatccagccctactggataggcgacggcgtggacaccccgcaagccggctatttcgggctcttccactactgcatcggcaacggcttctcccgggagctgacctgcaggggcagcttcacggacttctccacgctgccctcgggcgccttcaaagccgcctccttctttatcggcctctccatgatgctcatcattgcctgcatcatttgctttaccctcttcttcttctgcaacacggccactgtgtacaagatatgtgcctggatgcagctcacctccgctgcctgccttgtgcttggctgtatgattttccctgatggctgggactcagatgaagtaaaacggatgtgtggagaaaagacagacaagtacactcttggggcttgctcagtccgctgggcatacatcctggctattattggaattttggatgccctgatcctctcatttctagcatttgtgcttggtaatcgacaagacagcttgatggcagaggaactgaaggcagaaaacaaagttctgctaagccaatattctctagaatgagcacaaaacaaatcgaataacagctaaacaaatcgaataacagctaaacgaatcgaataacagcttttgtacatcaacatcaagaaggaatacgcctgagagagatcagagtatatagatgaatatgaacaagaatggaacattcacttgtcaacgcactttctaaatctagatcagcagagatgggagtgattttctggaaagagatgtgatcatggattaaacaccagctcattggaaactcattggatgagatcagaaaacgttcatgaaaaatcatattcaggaaataaggaagaggaatataaatgctctagagttaacatgtaaaatatatacgtactgaggtttgtaaactgtcctttttaaatcaaactgaaaacaaaaagctttaacctttcaacagaatttttaaaaaggcagttagttctaaattattcctatctcaatagccaagaggctgatcaagcgtcatttattgaggaagcatcttagaaaatgcctctgaatgttttcataggagccgtgacctttggttcttcatctctaccattcatttacttcactgtgtaattagttacaaccactcagttattaagagacgtaacgcttcaaactttttaccaagtctgtgttctgtttaatctgtccatacaagttattactgagaaagtgtttatgccatatactattactccatcaagctgtatattacaggaagtacatctttacatcataggttcccaagcaacatagatttccctatctttcaggaaacagcatcaaggaactctgaaaaatatagaaaaagttcattttcaccttggaagctcacgtgtaatattataggctactatcaaataaacactttttttctaattctccctagtatatgcataggaatttaatatactttataaataagtatctaaaatgtctcctacttttttcctatttctttgccatacatgttatcagaaatccatgtcttctatttcccttactgatgggcactca

SEQ ID NO: 93 - protein, 236 aa, Homo sapiens
MPGAAAAAAAAAAAMLPAQEAAKLYHTNYVRNSRAIGVLWAIFTICFAIVNVVCFIQPYWIGDGVDTPQAGYFGLFHYCIGNGFSRELTCRGSFTDFSTLPSGAFKAASFFIGLSMMLIIACIICFTLFFFCNTATVYKICAWMQLTSAACLVLGCMIFPDGWDSDEVKRMCGEKTDKYTLGACSVRWAYILAIIGILDALILSFLAFVLGNRQDSLMAEELKAENKVLLSQYSLE

SEQ ID NO: 94 - DNA, 1052 bp, Homo sapiens
tgccaagccctgccatgtagtgcacgcaggacatcaacaaacacagataacaggaaatgatccattccctgtggtcacttattctaaaggccccaaccttcaaagttcaagtagtgatatggatgactccacagaaagggagcagtcacgccttacttcttgccttaagaaaagagaagaaatgaaactgaaggagtgtgtttccatcctcccacggaaggaaagcccctctgtccgatcctccaaagacggaaagctgctggctgcaaccttgctgctggcactgctgtcttgctgcctcacggtggtgtctttctaccaggtggccgccctgcaaggggacctggccagcctccgggcagagctgcagggccaccacgcggagaagctgccagcaggagcaggagcccccaaggccggcctggaggaagctccagctgtcaccgcgggactgaaaatctttgaaccaccagctccaggagaaggcaactccagtcagaacagcagaaataagcgtgccgttcagggtccagaagaaacagtcactcaagactgcttgcaactgattgcagacagtgaaacaccaactatacaaaaaggatcttacacatttgttccatggcttctcagctttaaaaggggaagtgccctagaagaaaaagagaataaaatattggtcaaagaaactggttacttttttatatatggtcaggttttatatactgataagacctacgccatgggacatctaattcagaggaagaaggtccatgtctttggggatgaattgagtctggtgactttgtttcgatgtattcaaaatatgcctgaaacactacccaataattcctgctattcagctggcattgcaaaactggaagaaggagatgaactccaacttgcaataccaagagaaaatgcacaaatatcactggatggagatgtcacattttttggtgcattgaaactgctgtgacctacttacaccatgtctgtagctattttcctccctttctctgtacctctaagaagaaagaatctaactgaaaata

SEQ ID NO: 95 - protein, 285 aa, Homo sapiens
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 96 - DNA, 2544 bp, Homo sapiens
agatgctgccagggtccctgaagagggaagacacgcggaaacaggtaaaaatcattttgcttttattttgcattcaacaagcaagttattacggaacagcagttatgggccaggcatacctcccagagctgggaacacagtggggacctccctggctctctcttaccggtgttacaacaggttgtagacagacccctgtcttgagcatcctccttgccaggcctgctgagtcttctgagagtagggtaggttattggatgcccaggagggaagaaggagccagggaggtcagccccaaggttctgcaaggccctcaacaggcctggactgaggaggtctggacagcatggccctgtcctgagcctctgtgcataataactgctgtccctaacctccaccccaccctcagccttccaattcccgggcctggggccctactcctgtgctccagagactcctggagctccttgaggcagcacacagtcctgctctggaggcgcccatctcccactcatgctgggatgctccagcccgtcccagagcaggttgtggctggagggtgctggcagaggagggacaatggcccggctcctggaggcaagtgttggctgcagggaacggagtctagtccttgccacagcccttgttaccccttaggtaaccttaaggggatttcaaagaactctggctctgcaaccctgctaagttttttatggaacatgtaaaatagatcccatggccaaagaagtatggacaatgtattatactatactctaatccccatgtctagagattaatggtgtagatagagtttactgaaaggtttttaaagtcctgcaataaagaatcttacttaagccaggtgcggtggctcacgcctgtcatctcagcactttgggaggccaaggcgggaggatcacttgaggtcaggagttcgagaccagcctggccagcatggcgaaaccctgtctctactagaaatacagaaaaattagctgggtgtggtggtgggcacctgtaatcccagctactcgggaggctgaggcaggaggatcacttgaactggggaggtagaggttacagcgagccaagatcgcgccactgcactccagcctgggtgacagagggaaactccatctcaaaaaaacaacaacacaacaacaacaacaataacaacaaaaaaacaaagcaggactggagagaggtggaatgaagtggcaaggggttcctgaggggtgatttgggacaggacatctaaagccaggtgtacgctcacgtcctcagtcccccaggctcctgcacgggctctgttcttttgcagaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcgtgagtctccccggcatgcctgtgggaagggcaaggtctgtgtcaccttctccccagccccgcagggggcatgcacccagggcagggggaagcctgcacagacggcggcatcctccagccctggtcacgccgccttgtcagccctggtgtttcgggaaaaagatttgctctagcctaacagaataaaatggtccaccctcaagccatgacatgaattggggattatctggttaggtctttttgttcccctcttggtggggatttttttcgcatcattatcttgtgcctcattcattcaataaatacgtatcatgaacctactaggtaccaggccctattacggctgccaatggggggcatggggcggtgggcagggtgcagcagtgagcaaaactcttgccccacgcggagccagcgctgcagtgaaagagacagacaacaaatggattaccaaagaaatacagagcatgagccaagacattagaatctggaacaaagcaatgttaacaaagaaatatacaacactattgtaggtagtgatatgtgtgttaggaaaaaaataaggccgagagaggggagtgatggagagagacctctctaagaaggtgagcacttaggccgggtgcggtggctcacgcctgtaatcctagcactttggaaggccgaggcggggggatcacaaggtcaggagatcgagaccatcctggctaacatggtgaaaccccatctctagtaaaaatacaaaaaattagccaggcatgatggcaggcgcctgtagtcccagctacttgggaggccaaggcaggagaatgacatgaacccaggaggcggagcttgcagtgagctgagatcgcaccactgcactccaacctgggtgacgagtgagactccatctcaaaaaaaaaaaaaaaaaaaaa

SEQ ID NO: 97 - protein, 240 aa, Homo sapiens
MLPGSLKREDTRKQVKIILLLFCIQQASYYGTAVMGQAYLPELGTQWGPPWLSLTGVTTGCRQTPVLSILLARPAESSESRVGYWMPRREEGAREVSPKVLQGPQQAWTEEVWTAWPCPEPLCIITAVPNLHPTLSLPIPGPGALLLCSRDSWSSLRQHTVLLWRRPSPTHAGMLQPVPEQVVAGGCWQRRDNGPAPGGKCWLQGTESSPCHSPCYPLGNLKGISKNSGSATLLSFLWNM

SEQ ID NO: 98 - DNA, 2116 bp, Homo sapiens
acgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagttttccccagac

SEQ ID NO: 99 - protein, 647 aa, Homo sapiens
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGTMRTSFQIFQKMRGFITQS

SEQ ID NO: 100 - DNA, 1258 bp, Homo sapiens
tccactcacagcctgaagcatacccggcaggggctgtccccaggcccaacaagcaaagggcccagtagcgagggccactggagcccatctccggggggctgggcaggaagtagggtggggtttggggtagggatctggtaccctgggactgctgcaactcaaactaaccaacccactgggagaagatgcctgggggtccaggagtcctccaagctctgcctgccaccatcttcctcctcttcctgctgtctgctgtctacctgggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggccccctgagttcttgggcccgggcgaggaccccaatggtacgctgatcatccagaatgtgaacaagagccatgggggcatatacgtgtgccgggtccaggagggcaacgagtcataccagcagtcctgcggcacctacctccgcgtgcgccagccgccccccaggcccttcctggacatgggggagggcaccaagaaccgaatcatcacagccgaggggatcatcctcctgttctgcgcggtggtgcctgggacgctgctgctgttcaggaaacgatggcagaacgagaagctcgggttggatgccggggatgaatatgaagatgaaaacctttatgaaggcctgaacctggacgactgctccatgtatgaggacatctcccggggcctccagggcacctaccaggatgtgggcagcctcaacataggagatgtccagctggagaagccgtgacacccctactcctgccaggctgcccccgcctgctgtgcacccagctccagtgtctcagctcacttccctgggacattctcctttcagcccttctgggggcttccttagtcatattcccccagtggggggtgggagggtaacctcactcttctccaggccaggcctccttggactcccctgggggtgtcccactcttcttccctctaaactgccccacctcctaacctaatccccccgccccgctgcctttcccaggctcccctcaccccagcgggtaatgagcccttaatcgctgcctctaggggagctgattgtagcagcctcgttagtgtcaccccctcctccctgatctgtcagggccacttagtgataataaattcttcccaactgca

SEQ ID NO: 101 - protein, 226 aa, Homo sapiens
MPGGPGVLQALPATIFLLFLLSAVYLGPGCQALWMHKVPASLMVSLGEDAHFQCPHNSSNNANVTWWRVLHGNYTWPPEFLGPGEDPNGTLIIQNVNKSHGGIYVCRVQEGNESYQQSCGTYLRVRQPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 102 - DNA, 2919 bp, Homo sapiens
aaaaaaaaaaagtgatgagttgtgaggcaggtcgcggccctactgcctcaggagacgatgcgcagctcatttgcttaaatttgcagctgacggctgccacctctctagaggcacctggcggggagcctctcaacataagacagtgaccagtctggtgactcacagccggcacagccatgaactacccgctaacgctggaaatggacctcgagaacctggaggacctgttctgggaactggacagattggacaactataacgacacctccctggtggaaaatcatctctgccctgccacagaggggcccctcatggcctccttcaaggccgtgttcgtgcccgtggcctacagcctcatcttcctcctgggcgtgatcggcaacgtcctggtgctggtgatcctggagcggcaccggcagacacgcagttccacggagaccttcctgttccacctggccgtggccgacctcctgctggtcttcatcttgccctttgccgtggccgagggctctgtgggctgggtcctggggaccttcctctgcaaaactgtgattgccctgcacaaagtcaacttctactgcagcagcctgctcctggcctgcatcgccgtggaccgctacctggccattgtccacgccgtccatgcctaccgccaccgccgcctcctctccatccacatcacctgtgggaccatctggctggtgggcttcctccttgccttgccagagattctcttcgccaaagtcagccaaggccatcacaacaactccctgccacgttgcaccttctcccaagagaaccaagcagaaacgcatgcctggttcacctcccgattcctctaccatgtggcgggattcctgctgcccatgctggtgatgggctggtgctacgtgggggtagtgcacaggttgcgccaggcccagcggcgccctcagcggcagaaggcagtcagggtggccatcctggtgacaagcatcttcttcctctgctggtcaccctaccacatcgtcatcttcctggacaccctggcgaggctgaaggccgtggacaatacctgcaagctgaatggctctctccccgtggccatcaccatgtgtgagttcctgggcctggcccactgctgcctcaaccccatgctctacactttcgccggcgtgaagttccgcagtgacctgtcgcggctcctgacgaagctgggctgtaccggccctgcctccctgtgccagctcttccctagctggcgcaggagcagtctctctgagtcagagaatgccacctctctcaccacgttctaggtcccagtgtccccttttattgctgcttttccttggggcaggcagtgatgctggatgctccttccaacaggagctgggatcctaagggctcaccgtggctaagagtgtcctaggagtatcctcatttggggtagctagaggaaccaacccccatttctagaacatccctgccagctcttctgccggccctggggctaggctggagcccagggagcggaaagcagctcaaaggcacagtgaaggctgtccttacccatctgcacccccctgggctgagagaacctcacgcacctcccatcctaatcatccaatgctcaagaaacaacttctacttctgcccttgccaacggagagcgcctgcccctcccagaacacactccatcagcttaggggctgctgacctccacagcttcccctctctcctcctgcccacctgtcaaacaaagccagaagctgagcaccaggggatgagtggaggttaaggctgaggaaaggccagctggcagcagagtgtggccttcggacaactcagtccctaaaaacacagacattctgccaggcccccaagcctgcagtcatcttgaccaagcaggaagctcagactggttgagttcaggtagctgcccctggctctgaccgaaacagcgctgggtccaccccatgtcaccggatcctgggtggtctgcaggcagggctgactctaggtgcccttggaggccagccagtgacctgaggaagcgtgaaggccgagaagcaagaaagaaacccgacagagggaagaaaagagctttcttcccgaaccccaaggagggagatggatcaatcaaacccggcggtcccctccgccaggcgagatggggtggggtggagaactcctagggtggctgggtccaggggatgggaggttgtgggcattgatggggaaggaggctggcttgtcccctcctcactcccttcccataagctatagacccgaggaaactcagagtcggaacggagaaaggtggactggaaggggcccgtgggagtcatctcaaccatcccctccgtggcatcaccttaggcagggaagtgtaagaaacacactgaggcagggaagtccccaggccccaggaagccgtgccctgcccccgtgaggatgtcactcagatggaaccgcaggaagctgctccgtgcttgtttgctcacctggggtgtgggaggcccgtccggcagttctgggtgctccctaccacctccccagcctttgatcaggtggggagtcagggacccctgcccttgtcccactcaagccaagcagccaagctccttgggaggccccactggggaaataacagctgtggctcacgtgagagtgtcttcacggcaggacaacgaggaagccctaagacgtcccttttttctctgagtatctcctcgcaagctgggtaatcgatgggggagtctgaagcagatgcaaagaggcaagaggctggattttgaattttctttttaataaaaaggcacctataaaacaggtcaatacagtacaggcagcacagagacccccggaacaagcctaaaaattgtttcaaaataaaaaccaagaagatgtcttcacatattgtaaaaaaaaaaaaaaaaa

SEQ ID NO: 103 - protein, 372 aa, Homo sapiens
MNYPLTLEMDLENLEDLFWELDRLDNYNDTSLVENHLCPATEGPLMASFKAVFVPVAYSLIFLLGVIGNVLVLVILERHRQTRSSTETFLFHLAVADLLLVFILPFAVAEGSVGWVLGTFLCKTVIALHKVNFYCSSLLLACIAVDRYLAIVHAVHAYRHRRLLSIHITCGTIWLVGFLLALPEILFAKVSQGHHNNSLPRCTFSQENQAETHAWFTSRFLYHVAGFLLPMLVMGWCYVGVVHRLRQAQRRPQRQKAVRVAILVTSIFFLCWSPYHIVIFLDTLARLKAVDNTCKLNGSLPVAITMCEFLGLAHCCLNPMLYTFAGVKFRSDLSRLLTKLGCTGPASLCQLFPSWRRSSLSESENATSLTTF

SEQ ID NO: 104 - DNA, 1388 bp, Homo sapiens
gatttatactcttaatgggtactttctgactgaattttatgagctcattctgaagaggctgacgattttactatctcatttttttcctttctccagaatgggttctgggtgggtcccctgggtggtggctctgctagtgaatctgacccgactggattcctccatgactcaaggcacagactctccagaagattttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagagctcagtctgaatattcttggagaaagatgctgagtggcattgcagccttcctacttgggctaatcttccttctggtgggaatcgtcatccagctaagggctcagaaaggatatgtgaggacgcagatgtctggtaatgaggtctcaagagctgttctgctccctcagtcatgctaaggtcctcactgaagcttctctctctggagcctgaagtagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagccccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagatacaaaaaatgtaaaaaaaaaaaaaaaaa

SEQ ID NO: 105 - protein, 273 aa, Homo sapiens
MGSGWVPWVVALLVNLTRLDSSMTQGTDSPEDFVIQAKADCYFTNGTEKVQFVVRFIFNLEEYVRFDSDVGMFVALTKLGQPDAEQWNSRLDLLERSRQAVDGVCRHNYRLGAPFTVGRKVQPEVTVYPERTPLLHQHNLLHCSVTGFYPGDIKIKWFLNGQEERAGVMSTGPIRNGDWTFQTVVMLEMTPELGHVYTCLVDHSSLLSPVSVEWRAQSEYSWRKMLSGIAAFLLGLIFLLVGIVIQLRAQKGYVRTQMSGNEVSRAVLLPQSC

SEQ ID NO: 106 - DNA, 2341 bp, Homo sapiens
tccgcgatcgctgctttcagctgggcaacagcacagggcggtcctgcgcatccggggggctgcgctcccagaccggtggctggggagtaggttgcaggggtgtcactgtgtcaggggaggaggaggaggaggaggaagaagaggtagcggcaaggtcgcggtctgaggttccggtgctcgccgccgcccagctcccagccgaggctttctcaaccgcgtcaataaaaggccgccccgacccgcccccgcgccccgcagccctgccggacaccccgggctgcagctgagcgggcgcagacgggccgaggcgggcgccgggcgcgcagggaccgagggaccgagtgctccccatgagcgcacgtgggccgggcggtccgcaagcccggctgagagcgcgccatggggcaggcgggctgcaaggggctctgcctgtcgctgttcgactacaagaccgagaagtatgtcatcgccaagaacaagaaggtgggcctgctgtaccggctgctgcaggcctccatcctggcgtacctggtcgtatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccagggagagaacgtcttttttgtggtcaccaacctgattgtgacccccaaccagcggcagaacgtctgtgctgagaatgaaggcattcctgatggcgcgtgctccaaggacagcgactgccacgctggggaagcggttacagctggaaacggagtgaagaccggccgctgcctgcggagagagaacttggccaggggcacctgtgagatctttgcctggtgcccgttggagacaagctccaggccggaggagccattcctgaaggaggccgaagacttcaccattttcataaagaaccacatccgtttccccaaattcaacttctccaaaagcaatgtgatggacgtcaaggacagatctttcctgaaatcatgccactttggccccaagaaccactactgccccatcttccgactgggctccgtgatccgctgggccgggagcgacttccaggatatagccctggagggtggcgtgataggaattaatattgaatggaactgtgatcttgataaagctgcctctgagtgccaccctcactattcttttagccgtctggacaataaactttcaaagtctgtctcctccgggtacaacttcagatttgccagatattaccgagacgcagccggggtggagttccgcaccctgatgaaagcctacgggatccgctttgacgtgatggtgaacggcaagggtgctttcttctgcgacctggtactcatctacctcatcaaaaagagagagttttaccgtgacaagaagtacgaggaagtgaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggagcacgtgaattgcctctgcttacgttcaggccctgtcctaaacccagccgtctagcacccagtgatcccatgcctttgggaatcccaggatgctgcccaacgggaaatttgtacattgggtgctatcaatgccacatcacagggaccagccatcacagagcaaagtgacctccacgtctgatgctggggtcatcaggacggacccatcatggctgtctttttgccccaccccctgccgtcagttcttcctttctccgtggctggcttcccgcactagggaacgggttgtaaatggggaacatgacttccttccggagtccttgagcacctcagctaaggaccgcagtgccctgtagagttcctagattacctcactgggaatagcattgtgcgtgtccggaaaagggctccatttggttccagcccactcccctctgcaagtgccgcagcttccctcagagcatactctccagtggatccaagtactctctctcctaaagacaccaccttcctgccagctgtttgcccttaggccagtacacagaattaaagtgggggagatggcagacgctttctgggacctgcccaagatatgtattctctgacactcttatttggtcataaaacaataaatggtgtcaatttcaaaaaaaaaaaaaaaaaaaaaaaaaaaaaaaaaaa

SEQ ID NO: 107 - protein, 422 aa, Homo sapiens
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQGENVFFVVTNLIVTPNQRQNVCAENEGIPDGACSKDSDCHAGEAVTAGNGVKTGRCLRRENLARGTCEIFAWCPLETSSRPEEPFLKEAEDFTIFIKNHIRFPKFNFSKSNVMDVKDRSFLKSCHFGPKNHYCPIFRLGSVIRWAGSDFQDIALEGGVIGINIEWNCDLDKAASECHPHYSFSRLDNKLSKSVSSGYNFRFARYYRDAAGVEFRTLMKAYGIRFDVMVNGKGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRST

SEQ ID NO: 108 - DNA, 1548 bp, Homo sapiens
aattgctaagccgtgcagtcacagagggaacacagagcctagttgtaaacggacagagacgagaggggcaagggaggacagtggatgacagggaagacgagtgggggcagagctgctcaggaccatggctgaggccatcacctatgcagatctgaggtttgtgaaggctcccctgaagaagagcatctccagccggttaggacaggacccaggggctgatgatgatggggaaatcacctacgagaatgttcaagtgcccgcagtcctaggggtgccctcaagcttggcttcttctgtactaggggacaaagcagcggtcaagtcggagcagccaactgcgtcctggagagccgtgacgtcaccagctgtcgggcggattctcccctgccgcacaacctgcctgcgatacctcctgctcggcctgctcctcacctgcctgctgttaggagtgaccgccatctgcctgggagtgcgctatctgcaggtgtctcagcagctccagcagacgaacagggttctggaagtcactaacagcagcctgaggcagcagctccgcctcaagataacgcagctgggacagagtgcagaggatctgcaggggtccaggagagagctggcgcagagtcaggaagcactacaggtggaacagagggctcatcaggcggccgaagggcagctacaggcctgccaggcagacagacagaagacgaaggagaccttgcaaagtgaggagcaacagaggagggccttggagcagaagctgagcaacatggagaacagactgaagcccttcttcacatgcggctcagcagacacctgctgtccgtcgggatggataatgcatcagaaaagctgcttttacatctcacttacttcaaaaaattggcaggagagccaaaaacaatgtgaaactctgtcttccaagctggccacattcagtgaaatttatccacaatcacactcttactacttcttaaattcactgttgccaaatggtggttcagggaattcatattggactggcctcagctctaacaaggattggaagttgactgatgatacacaacgcactaggacttatgctcaaagctcaaaatgtaacaaggtacataaaacttggtcatggtggacactggagtcagagtcatgtagaagttctcttccctacatctgtgagatgacagctttcaggtttccagattaggacagtcctttgcactgagttgacactcatgccaacaagaacctgtgcccctccttcctaacctgaggcctggggttcctcagaccatctccttcattctgggcagtgcccagccaccggctgacccacacctgacacttccagccagtctgctgcctgctccctcttcctgaaactggactgttcctgggaaaagggtgaagccacctctagaagggactttggcctccccccaagaacttcccatggtagaatggggtgggggaggagggcgcacgggctgagcggataggggcggcccggagccagccaggcagttttattgaaatctttttaaataattg

SEQ ID NO: 109 - protein, 359 aa, Homo sapiens
MAEAITYADLRFVKAPLKKSISSRLGQDPGADDDGEITYENVQVPAVLGVPSSLASSVLGDKAAVKSEQPTASWRAVTSPAVGRILPCRTTCLRYLLLGLLLTCLLLGVTAICLGVRYLQVSQQLQQTNRVLEVTNSSLRQQLRLKITQLGQSAEDLQGSRRELAQSQEALQVEQRAHQAAEGQLQACQADRQKTKETLQSEEQQRRALEQKLSNMENRLKPFFTCGSADTCCPSGWIMHQKSCFYISLTSKNWQESQKQCETLSSKLATFSEIYPQSHSYYFLNSLLPNGGSGNSYWTGLSSNKDWKLTDDTQRTRTYAQSSKCNKVHKTWSWWTLESESCRSSLPYICEMTAFRFPD

SEQ ID NO: 110 - DNA, 2725 bp, Homo sapiens
agaatgctgagcagtcaacagcatttcttgttccaagatcacccttctgagtacctctctggctgccaaattgccagggccttcacagtttgattccatttctcagctccaagcattaggtaaacccaccaagcaatcctagcctgtgatggcgtttgacgtcagctgcttcttttgggtggtgctgttttctgccggctgtaaagtcatcacctcctgggatcagatgtgcattgagaaagaagccaacaaaacatataactgtgaaaatttaggtctcagtgaaatccctgacactctaccaaacacaacagaatttttggaattcagctttaattttttgcctacaattcacaatagaaccttcagcagactcatgaatcttacctttttggatttaactaggtgccagattaactggatacatgaagacacttttcaaagccatcatcaattaagcacacttgtgttaactggaaatcccctgatattcatggcagaaacatcgcttaatgggcccaagtcactgaagcatcttttcttaatccaaacgggaatatccaatctcgagtttattccagtgcacaatctggaaaacttggaaagcttgtatcttggaagcaaccatatttcctccattaagttccccaaagacttcccagcacggaatctgaaagtactggattttcagaataatgctatacactacatctctagagaagacatgaggtctctggagcaggccatcaacctaagcctgaacttcaatggcaataatgttaaaggtattgagcttggggcttttgattcaacgatcttccaaagtttgaactttggaggaactccaaatttgtctgttatattcaatggtctgcagaactctactactcagtctctctggctgggaacatttgaggacattgatgacgaagatattagttcagccatgctcaagggactctgtgaaatgtctgttgagagcctcaacctgcaggaacaccgcttctctgacatctcatccaccacatttcagtgcttcacccaactccaagaattggatctgacagcaactcacttgaaagggttaccctctgggatgaagggtctgaacttgctcaagaaattagttctcagtgtaaatcatttcgatcaattgtgtcaaatcagtgctgccaatttcccctcccttacacacctctacatcagaggcaacgtgaagaaacttcaccttggtgttggctgcttggagaaactaggaaaccttcagacacttgatttaagccataatgacatagaggcttctgactgctgcagtctgcaactcaaaaacctgtcccacttgcaaaccttaaacctgagccacaatgagcctcttggtctccagagtcaggcattcaaagaatgtcctcagctagaactcctcgatttggcatttacccgcttacacattaatgctccacaaagtcccttccaaaacctccatttccttcaggttctgaatctcacttactgcttccttgataccagcaatcagcatcttctagcaggcctaccagttctccggcatctcaacttaaaagggaatcactttcaagatgggactatcacgaagaccaacctacttcagaccgtgggcagcttggaggttctgattttgtcctcttgtggtctcctctctatagaccagcaagcattccacagcttgggaaaaatgagccatgtagacttaagccacaacagcctgacatgcgacagcattgattctcttagccatcttaagggaatctacctcaatctggctgccaacagcattaacatcatctcaccccgtctcctccctatcttgtcccagcagagcaccattaatttaagtcataaccccctggactgcacttgctcgaatattcatttcttaacatggtacaaagaaaacctgcacaaacttgaaggctcggaggagaccacgtgtgcaaacccgccatctctaaggggagttaagctatctgatgtcaagctttcctgtgggattacagccataggcattttctttctcatagtatttctattattgttggctattctgctattttttgcagttaaataccttctcaggtggaaataccaacacatttagtgctgaaggtttccagagaaagcaaataagtgtgcttagcaaaattgctctaagtgaaagaactgtcatctgctggtgaccagaccagacttttcagattgcttcctggaactgggcagggactcactgtgcttttctgagcttcttactcctgtgagtcccagagctaaagaaccttctaggcaagtacaccgaatgactcagtccagagggtcagatgctgctgtgagaggcacagagccctttccgcatgtggaagagtgggaggaagcagagggagggactgggcagggactgccggccccggagtctcccacagggaggccattccccttctactcaccgacatccctcccagcaccacacaccccgcccctgaaaggagatcatcagcccccacaatttgtcagagctgaagccagcccactacccacccccactacagcattgtgcttgggtctgggttctcagtaatgtagccatttgagaaacttacttggggacaaagtctcaatccttattttaaatgaaaaaagaaaagaaaagcataataaatttaaaagaaaaggctgagaaatgaaaaaaaaaaaa

SEQ ID NO: 111 - protein, 661 aa, Homo sapiens
MAFDVSCFFWVVLFSAGCKVITSWDQMCIEKEANKTYNCENLGLSEIPDTLPNTTEFLEFSFNFLPTIHNRTFSRLMNLTFLDLTRCQINWIHEDTFQSHHQLSTLVLTGNPLIFMAETSLNGPKSLKHLFLIQTGISNLEFIPVHNLENLESLYLGSNHISSIKFPKDFPARNLKVLDFQNNAIHYISREDMRSLEQAINLSLNFNGNNVKGIELGAFDSTIFQSLNFGGTPNLSVIFNGLQNSTTQSLWLGTFEDIDDEDISSAMLKGLCEMSVESLNLQEHRFSDISSTTFQCFTQLQELDLTATHLKGLPSGMKGLNLLKKLVLSVNHFDQLCQISAANFPSLTHLYIRGNVKKLHLGVGCLEKLGNLQTLDLSHNDIEASDCCSLQLKNLSHLQTLNLSHNEPLGLQSQAFKECPQLELLDLAFTRLHINAPQSPFQNLHFLQVLNLTYCFLDTSNQHLLAGLPVLRHLNLKGNHFQDGTITKTNLLQTVGSLEVLILSSCGLLSIDQQAFHSLGKMSHVDLSHNSLTCDSIDSLSHLKGIYLNLAANSINIISPRLLPILSQQSTINLSHNPLDCTCSNIHFLTWYKENLHKLEGSEETTCANPPSLRGVKLSDVKLSCGITAIGIFFLIVFLLLLAILLFFAVKYLLRWKYQHI

SEQ ID NO: 112 - DNA, 3116 bp, Homo sapiens
aacttccgatatcaacttcctcaaacctctgatgagctgctgctgctcgactctgaggtgcattctttttttgatgagaggcatctctaggtaccatccctgacctggtcctcatgctgccgaggctgttgctgttgatctgtgctccactctgtgaacctgccgagctgtttttgatagccagcccctcccatcccacagaggggagcccagtgaccctgacgtgtaagatgccctttctacagagttcagatgcccagttccagttctgctttttcagagacacccgggccttgggcccaggctggagcagctcccccaagctccagatcgctgccatgtggaaagaagacacagggtcatactggtgcgaggcacagacaatggcgtccaaagtcttgaggagcaggagatcccagataaatgtgcacagggtccctgtcgctgatgtgagcttggagactcagcccccaggaggacaggtgatggagggagacaggctggtcctcatctgctcagttgctatgggcacaggagacatcaccttcctttggtacaaaggggctgtaggtttaaaccttcagtcaaagacccagcgttcactgacagcagagtatgagattccttcagtgagggagagtgatgctgagcaatattactgtgtagctgaaaatggctatggtcccagccccagtgggctggtgagcatcactgtcagaatcccggtgtctcgcccaatcctcatgctcagggctcccagggcccaggctgcagtggaggatgtgctggagcttcactgtgaggccctgagaggctctcctccgatcctgtactggttttatcacgaggatatcaccctggggagcaggtcggccccctctggaggaggagcctccttcaacctttccctgactgaagaacattctggaaactactcctgtgaggccaacaatggcctgggggcccagcgcagtgaggcggtgacactcaacttcacagtgcctactggggccagaagcaatcatcttacctcaggagtcattgaggggctgctcagcacccttggtccagccaccgtggccttattattttgctacggcctcaaaagaaaaataggaagacgttcagccagggatccactcaggagccttcccagccctctaccccaagagttcacctacctcaactcacctaccccagggcagctacagcctatatatgaaaatgtgaatgttgtaagtggggatgaggtttattcactggcgtactataaccagccggagcaggaatcagtagcagcagaaaccctggggacacatatggaggacaaggtttccttagacatctattccaggctgaggaaagcaaacattacagatgtggactatgaagatgctatgtaaggttatggaagattctgctctttgaaaaccatccatgaccccaagcctcaggcctgatatgttcttcagagatcctggggcattagctttccagtatacctcttctggatgccattctccatggcactattccttcatctactgtgaagtgaagttggcgcagccctgaagaaactacctaggagaactaatagacacaggagtgacagggactttgttatcagaaccagattcctgccggctcctttgaaaacaggtcatattgtgctcttctgtttacaagaggaaacaagatggaataaaagaaattgggatcttgggttggagggacagtgaagcttagagcacatgaactcaaggttagtgactctgcaggacttcacagagagagctgtgcccatcattcagtccaagtgctttctctgcccagacagcacagaactccagccccgctacttacatggatcatcgagtttccacctaaaatatgattctatttattttgagtcactgttaccaaattagaactaaaacaaagttacataaaaagttattgtgactccacttaattttagtgacgtatttttgtatatataggccaacctataccacatccaaaattatgtatctattacagcccctagaagctttataaatacagtgtgtcttcttttattcacaaaatttttgaaatcgtggtaatatggtttgaaacctgtatcttaattattttttttttaaattgagacagggtctcactctgtcactcaatctggaatgcagtggcacaatcttgcctcactgcaacgcctgcctctcaggctcaagcaaacctctcacctcagcctgctgagtagctgggactacaggcacatgccaccaaacttggccattttttgtcttacgtagagacaagatttcaccgttttgcccaggctggtctcaaactcctgggctcaagcaatgtattgaattttaaaataaccaggcactcactcttatgaattaataaacatttggaggtatataaagtaaaaagttaaagtctttcctgtaagttaacacaaatgttaactattgttaaaaactttacaggtagctctctagatatttttctatttttgtatgtatacttatgcatacatgtaagtatataaacatttagaagtgtacctatctaacaaactattatgaaatactttcaaatctgtaaatagatctattatactattttaaaagtctctatagtagtgtgttatatagataaatcataacttttttctttttttattgtagtaaatatgcacaacataaaattgatcattttaaccatttttaagtgtacaattcagtggcattaagtactatcataatatattttaatccttctcatcactggtggacattaaggagactctcaaaaaattcatattataaaaacaaagttcaaacaaatgtctttgtactagcatattatggcactcctgctggattatctgaaggataaatttgtaaatctagtattgctagattatgcatattaaatattcttgttaaatagtcttcaatgtctctcaggtaaggctgtatcaatttatatcttcaccaacaacgtctgggaaatcagtttgtggggtgtattacttagttttcacattgctaataaagacatatccaagactgggtaatttataaaaaaaaaaaaaaaaaaaa

SEQ ID NO: 113 - protein, 429 aa, Homo sapiens
MLPRLLLLICAPLCEPAELFLIASPSHPTEGSPVTLTCKMPFLQSSDAQFQFCFFRDTRALGPGWSSSPKLQIAAMWKEDTGSYWCEAQTMASKVLRSRRSQINVHRVPVADVSLETQPPGGQVMEGDRLVLICSVAMGTGDITFLWYKGAVGLNLQSKTQRSLTAEYEIPSVRESDAEQYYCVAENGYGPSPSGLVSITVRIPVSRPILMLRAPRAQAAVEDVLELHCEALRGSPPILYWFYHEDITLGSRSAPSGGGASFNLSLTEEHSGNYSCEANNGLGAQRSEAVTLNFTVPTGARSNHLTSGVIEGLLSTLGPATVALLFCYGLKRKIGRRSARDPLRSLPSPLPQEFTYLNSPTPGQLQPIYENVNVVSGDEVYSLAYYNQPEQESVAAETLGTHMEDKVSLDIYSRLRKANITDVDYEDAM

SEQ ID NO: 114 - DNA, 2797 bp, Homo sapiens
gtgcagtgtcctgactgtaagatcaagtccaaacctgttttggaattgaggaaacttctcttttgatctcagcccttggtggtccaggtcttcatgctgctgtgggtgatattactggtcctggctcctgtcagtggacagtttgcaaggacacccaggcccattattttcctccagcctccatggaccacagtcttccaaggagagagagtgaccctcacttgcaagggatttcgcttctactcaccacagaaaacaaaatggtaccatcggtaccttgggaaagaaatactaagagaaaccccagacaatatccttgaggttcaggaatctggagagtacagatgccaggcccagggctcccctctcagtagccctgtgcacttggatttttcttcagcttcgctgatcctgcaagctccactttctgtgtttgaaggagactctgtggttctgaggtgccgggcaaaggcggaagtaacactgaataatactatttacaagaatgataatgtcctggcattccttaataaaagaactgacttccatattcctcatgcatgtctcaaggacaatggtgcatatcgctgtactggatataaggaaagttgttgccctgtttcttccaatacagtcaaaatccaagtccaagagccatttacacgtccagtgctgagagccagctccttccagcccatcagcgggaacccagtgaccctgacctgtgagacccagctctctctagagaggtcagatgtcccgctccggttccgcttcttcagagatgaccagaccctgggattaggctggagtctctccccgaatttccagattactgccatgtggagtaaagattcagggttctactggtgtaaggcagcaacaatgcctcacagcgtcatatctgacagcccgagatcctggatacaggtgcagatccctgcatctcatcctgtcctcactctcagccctgaaaaggctctgaattttgagggaaccaaggtgacacttcactgtgaaacccaggaagattctctgcgcactttgtacaggttttatcatgagggtgtccccctgaggcacaagtcagtccgctgtgaaaggggagcatccatcagcttctcactgactacagagaattcagggaactactactgcacagctgacaatggccttggcgccaagcccagtaaggctgtgagcctctcagtcactgttcccgtgtctcatcctgtcctcaacctcagctctcctgaggacctgatttttgagggagccaaggtgacacttcactgtgaagcccagagaggttcactccccatcctgtaccagtttcatcatgaggatgctgccctggagcgtaggtcggccaactctgcaggaggagtggccatcagcttctctctgactgcagagcattcagggaactactactgcacagctgacaatggctttggcccccagcgcagtaaggcggtgagcctctccatcactgtccctgtgtctcatcctgtcctcaccctcagctctgctgaggccctgacttttgaaggagccactgtgacacttcactgtgaagtccagagaggttccccacaaatcctataccagttttatcatgaggacatgcccctgtggagcagctcaacaccctctgtgggaagagtgtccttcagcttctctctgactgaaggacattcagggaattactactgcacagctgacaatggctttggtccccagcgcagtgaagtggtgagcctttttgtcactgttccagtgtctcgccccatcctcaccctcagggttcccagggcccaggctgtggtgggggacctgctggagcttcactgtgaggccccgagaggctctcccccaatcctgtactggttttatcatgaggatgtcaccctggggagcagctcagccccctctggaggagaagcttctttcaacctctctctgactgcagaacattctggaaactactcatgtgaggccaacaatggcctagtggcccagcacagtgacacaatatcactcagtgttatagttccagtatctcgtcccatcctcaccttcagggctcccagggcccaggctgtggtgggggacctgctggagcttcactgtgaggccctgagaggctcctccccaatcctgtactggttttatcatgaagatgtcaccctgggtaagatctcagccccctctggaggaggggcctccttcaacctctctctgactacagaacattctggaatctactcctgtgaggcagacaatggtctggaggcccagcgcagtgagatggtgacactgaaagttgcaggtgagtgggccctgcccaccagcagcacatctgagaactgactgtgcctgttctccctgcagctgaaaatggagccacagagctcctcagggctgtttgcttgtgtggcatcccagcacacttcctgcctgcagaacctccctgtgaaagtctcggatcctttgtggtatggttccaggaatctgatgtttcccagcagtcttcttgaagatgatcaaagcacctcactaaaaatgcaaataagacttttttagaacataaactatattctgaactgaaattattacatgaaaatgaaaccaaagaattctgagcatatgtttctctgccgtagaaaggattaagctgtttcttgtccggattcttctctcattgacttctaagaagcctctactcttgagtctctttcattactggggatgtaaatgttccttacatttccacattaaaaatcctatgttaacg

SEQ ID NO: 115 - protein, 759 aa, Homo sapiens
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPHSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEDAALERRSANSAGGVAISFSLTAEHSGNYYCTADNGFGPQRSKAVSLSITVPVSHPVLTLSSAEALTFEGATVTLHCEVQRGSPQILYQFYHEDMPLWSSSTPSVGRVSFSFSLTEGHSGNYYCTADNGFGPQRSEVVSLFVTVPVSRPILTLRVPRAQAVVGDLLELHCEAPRGSPPILYWFYHEDVTLGSSSAPSGGEASFNLSLTAEHSGNYSCEANNGLVAQHSDTISLSVIVPVSRPILTFRAPRAQAVVGDLLELHCEALRGSSPILYWFYHEDVTLGKISAPSGGGASFNLSLTTEHSGIYSCEADNGLEAQRSEMVTLKVAGEWALPTSSTSEN

SEQ ID NO: 116 - DNA, 1814 bp, Homo sapiens
gcagagctcgagaggcggctgccgggctgcggggcgccttgactctccctccaccctgcctcctcgggctccactcgtctgcccctggactcccgtctcctcctgtcctccggcttcccagagctccctccttatggcagcagcttcccgcgtctccggcgcagcttctcagcggacgaccctctcgctccggggctgagcccagtccctggatgttgctgaaactctcgagatcatgcgcgggtttggctgctgcttccccgccgggtgccactgccaccgccgccgcctctgctgccgccgtccgcgggatgctcagtagcccgctgcccggcccccgcgatcctgtgttcctcggaagccgtttgctgctgcagagttgcacgaactagtcatggtgctgtgggagtccccgcggcagtgcagcagctggacactttgcgagggcttttgctggctgctgctgctgcccgtcatgctactcatcgtagcccgcccggtgaagctcgctgctttccctacctccttaagtgactgccaaacgcccaccggctggaattgctctggttatgatgacagagaaaatgatctcttcctctgtgacaccaacacctgtaaatttgatggggaatgtttaagaattggagacactgtgacttgcgtctgtcagttcaagtgcaacaatgactatgtgcctgtgtgtggctccaatggggagagctaccagaatgagtgttacctgcgacaggctgcatgcaaacagcagagtgagatacttgtggtgtcagaaggatcatgtgccacagatgcaggatcaggatctggagatggagtccatgaaggctctggagaaactagtcaaaaggagacatccacctgtgatatttgccagtttggtgcagaatgtgacgaagatgccgaggatgtctggtgtgtgtgtaatattgactgttctcaaaccaacttcaatcccctctgcgcttctgatgggaaatcttatgataatgcatgccaaatcaaagaagcatcgtgtcagaaacaggagaaaattgaagtcatgtctttgggtcgatgtcaagataacacaactacaactactaagtctgaagatgggcattatgcaagaacagattatgcagagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaaggaaatgccccagaagcaacagaattcacagacagaagcaaaatacagggcactacagttcagacaatacaacaagagcgtccacgaggttaatctaaagggagcatgtttcacagtggctggactaccgagagcttggactacacaatacagtattatagacaaaagaataagacaagagatctacacatgttgccttgcatttgtggtaatctacaccaatgaaaacatgtactacagctatatttgattatgtatggatatatttgaaatagtatacattgtcttgatgttttttctgtaatgtaaataaactatttatatcacacaatatagttttttctttcccatgtatttgttatatataataaatactcagtgatgagaaaaaaa

SEQ ID NO: 117 - protein, 374 aa, Homo sapiens
MVLWESPRQCSSWTLCEGFCWLLLLPVMLLIVARPVKLAAFPTSLSDCQTPTGWNCSGYDDRENDLFLCDTNTCKFDGECLRIGDTVTCVCQFKCNNDYVPVCGSNGESYQNECYLRQAACKQQSEILVVSEGSCATDAGSGSGDGVHEGSGETSQKETSTCDICQFGAECDEDAEDVWCVCNIDCSQTNFNPLCASDGKSYDNACQIKEASCQKQEKIEVMSLGRCQDNTTTTTKSEDGHYARTDYAENANKLEESAREHHIPCPEHYNGFCMHGKCEHSINMQEPSCRCDAGYTGQHCEKKDYSVLYVVPGPVRFQYVLIAAVIGTIQIAVICVVVLCITRKCPRSNRIHRQKQNTGHYSSDNTTRASTRLI

SEQ ID NO: 118 - DNA, 2653 bp, Homo sapiens
ctcaaaaggggccggatttccttctcctggaggcagatgttgcctctctctctcgctcggattggttcagtgcactctagaaacactgctgtggtggagaaactggaccccaggtctggagcgaattccagcctgcagggctgataagcgaggcattagtgagattgagagagactttaccccgccgtggtggttggagggcgcgcagtagagcagcagcacaggcgcgggtcccgggaggccggctctgctcgcgccgagatgtggaatctccttcacgaaaccgactcggctgtggccaccgcgcgccgcccgcgctggctgtgcgctggggcgctggtgctggcgggtggcttctttctcctcggcttcctcttcgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaagaggattctttagagaatccgtattgaatttgtgtggtatgtcactcagaaagaatcgtaatgggtatattgataaattttaaaattggtatatttgaaataaagttgaatattatatataaaaaaaaaaaaaaaaaaa

SEQ ID NO: 119 - protein, 750 aa, Homo sapiens
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 120 - DNA, 2996 bp, Homo sapiens
cgcagccacccatgcgcgcgcgctcgcaagaccaccagcgcccagagccccagtctgaggcttggcgccgggggtctgcgggcgaggggagctctctacgtgcgaggggctagcgggagccggcacaagagggtcgaggagccaggaaccccaaacgtccggcgccaggcgctagccaagctgctgcgcgccccggcgcccagctggctcggggacagccgctgggtgtcggagaccggagctagcggattgcagcggaaaagcaaagatgtcacactggatccttggcctccagggtccattaaggtgagaataagatctctgggctggctggaactagcctaagactgaaaagcagccatggacatggcggatgagccactcaatggaagccacacatggctatccattccatttgacctcaatggctctgtggtgtcaaccaacacctcaaaccagacagagccgtactatgacctgacaagcaatgcagtcctcacattcatctattttgtggtctgcatcattgggttgtgtggcaacacacttgtcatttatgtcatcctccgctatgccaagatgaagaccatcaccaacatttacatcctcaacctggccatcgcagatgagctcttcatgctgggtctgcctttcttggctatgcaggtggctctggtccactggccctttggcaaggccatttgccgggtggtcatgactgtggatggcatcaatcagttcaccagcatcttctgcctgacagtcatgagcatcgaccgatacctggctgtggtccaccccatcaagtcggccaagtggaggagaccccggacggccaagatgatcaccatggctgtgtggggagtctctctgctggtcatcttgcccatcatgatatatgctgggctccggagcaaccagtgggggagaagcagctgcaccatcaactggccaggtgaatctggggcttggtacacagggttcatcatctacactttcattctggggttcctggtacccctcaccatcatctgtctttgctacctgttcattatcatcaaggtgaagtcctctggaatccgagtgggctcctctaagaggaagaagtctgagaagaaggtcacccgaatggtgtccatcgtggtggctgtcttcatcttctgctggcttcccttctacatattcaacgtttcttccgtctccatggccatcagccccaccccagcccttaaaggcatgtttgactttgtggtggtcctcacctatgctaacagctgtgccaaccctatcctatatgccttcttgtctgacaacttcaagaagagcttccagaatgtcctctgcttggtcaaggtgagcggcacagatgatggggagcggagtgacagtaagcaggacaaatcccggctgaatgagaccacggagacccagaggaccctcctcaatggagacctccaaaccagtatctgaactgcttggggggtgggaaagaaccaagccatgctctgtctactggcaatgggctccctacccacactggcttcctgcctcccacccctcacacctggcttctagaatagaggattgctcagcatgagtccaattcagagaacggtgtttgagtcagcttgtctgattgaatgataatgtgctaaattgattacctcccccttaaagcgaacactgaaatgcaggtagacaattcaaagtctggagaagagggatcatgcctggatatgatctttagaaacaacaaaaatagaaaaaaataagtatctgtgtgtttgtgtattgaaaactcaatatgtaatcttgtgtttttatatgtatacttgtatattcctatttattctctgtataggcattacctacgttcctgtgtttacatacacaagtagcaaattcgagtatgcatagtgtagatggacatttgccacaacacactgcccgcagaaatggacttaccgtgaagccaataaagttcaagcttcagggatctctcttgcacgggccttgccaaggcccaggagggacttgggcagtatgttcatgtggtcatatgtttttgtaaaaaattgtgaaagtaagatatgtttgtattgtttttcttaaagaggaacctcgtataagcttcaagcctcacaaaccttctagcctctgcccttggggatttgcttcattaatttcaggcaagtgaggtcaatgtaagaagggaaagggagaagatatttgaagaaccagaatgtaaattcatgtgtttccacttctcagatatagtcagagaattattcatttgcccaaaaggacttaagtggttgtggtcatccatcattgtatttatcaagacaaagccaactttgttataagattgcatttttttcttttcaaattgctttagtttttcttagggagctatgagggggaaaaatcactaacatgaaaggcaaaaaatggactatgattcctgtggggaaacaatttcattctctccatcgtgaaaataagtgaataagagtgaagcaaaattacacctttatgagaaaccataaaattgtttttatttttcaggccagacatagcttcctaatgaaagaaaatggaaatgtaattcgacgactcctcaaaggggactttagaggacttcatacaaagctgggcattaagaaaaccacaatgcatggccgggcgtggtggcttacacctgtaatcccagcactttgggaggccgaggtgggtggatcacccgaggtcaggagttcgagaccagcctggccaacatggtgaaaccccatcactactaaaaatatgtaaattagtcgggcgtggtgtcacgtgcctgtaatcctagctgctcgggaggctgaggcaggagaatcacttgaacttgggaggtggaggttgcagtaagctgagattgtgccactgcactctagcctgagcaacaagagcaaaactcagtctcaaaaaaaaaaaaaaaaaaaaaaaaaaaaaaaaaa

SEQ ID NO: 121 - protein, 369 aa, Homo sapiens
MDMADEPLNGSHTWLSIPFDLNGSVVSTNTSNQTEPYYDLTSNAVLTFIYFVVCIIGLCGNTLVIYVILRYAKMKTITNIYILNLAIADELFMLGLPFLAMQVALVHWPFGKAICRVVMTVDGINQFTSIFCLTVMSIDRYLAVVHPIKSAKWRRPRTAKMITMAVWGVSLLVILPIMIYAGLRSNQWGRSSCTINWPGESGAWYTGFIIYTFILGFLVPLTIICLCYLFIIIKVKSSGIRVGSSKRKKSEKKVTRMVSIVVAVFIFCWLPFYIFNVSSVSMAISPTPALKGMFDFVVVLTYANSCANPILYAFLSDNFKKSFQNVLCLVKVSGTDDGERSDSKQDKSRLNETTETQRTLLNGDLQTSI

SEQ ID NO: 122 - DNA, 1245 bp, Homo sapiens
cgtcctcccttcttctcttgcagagcctgacgcaccccagggctgccgccatggagcccctgttcccagcctccacgcccagctggaacgcctcctccccgggggctgcctctggaggcggtgacaacaggacgctggtggggccggcgccctcggcaggggcccgggcggtgctggtgcccgtgctgtacctgctggtgtgtgcggccgggctgggcgggaacacgctggtcatctacgtggtgctgcgcttcgccaagatgaagaccgtcaccaacatctacattctcaacctggcagtggccgacgtcctgtacatgctggggctgcctttcctggccacgcagaacgccgcgtccttctggcccttcggccccgtcctgtgccgcctggtcatgacgctggacggcgtcaaccagttcaccagtgtcttctgcctgacagtcatgagcgtggaccgctacctggcagtggtgcacccgctgagctcggcccgctggcgccgcccgcgtgtggccaagctggcgagcgccgcggcctgggtcctgtctctgtgcatgtcgctgccgctcctggtgttcgcggacgtgcaggagggcggtacctgcaacgccagctggccggagcccgtggggctgtggggcgccgtcttcatcatctacacggccgtgctgggcttcttcgcgccgctgctggtcatctgcctgtgctacctgctcatcgtggtgaaggtgagggcggcgggcgtgcgcgtgggctgcgtgcggcggcgctcggagcggaaggtgacgcgcatggtgttggtggtggtgctggtgtttgcgggatgttggctgcccttcttcaccgtcaacatcgtcaacctggccgtggcgctgccccaggagcccgcctccgccggcctctacttcttcgtggtcatcctctcctacgccaacagctgtgccaaccccgtcctctacggcttcctctctgacaacttccgccagagcttccagaaggttctgtgcctccgcaagggctctggtgccaaggacgctgacgccacggagccgcgtccagacaggatccggcagcagcaggaggccacgccgcccgcgcaccgcgccgcagccaacgggcttatgcagaccagcaagctgtgagagtgcaggcggggggtgggcggccccgtgtcacccccaggagcggaggttgcactgcggtgacccccacccatgacctgccagtcaggatgctccccgg

SEQ ID NO: 123 - protein, 364 aa, Homo sapiens
MEPLFPASTPSWNASSPGAASGGGDNRTLVGPAPSAGARAVLVPVLYLLVCAAGLGGNTLVIYVVLRFAKMKTVTNIYILNLAVADVLYMLGLPFLATQNAASFWPFGPVLCRLVMTLDGVNQFTSVFCLTVMSVDRYLAVVHPLSSARWRRPRVAKLASAAAWVLSLCMSLPLLVFADVQEGGTCNASWPEPVGLWGAVFIIYTAVLGFFAPLLVICLCYLLIVVKVRAAGVRVGCVRRRSERKVTRMVLVVVLVFAGCWLPFFTVNIVNLAVALPQEPASAGLYFFVVILSYANSCANPVLYGFLSDNFRQSFQKVLCLRKGSGAKDADATEPRPDRIRQQQEATPPAHRAAANGLMQTSKL

SEQ ID NO: 124 - DNA, 5717 bp, Homo sapiens
ggctaccgctcccggcttggcgtcccgcgcgcacttcggcgatggcttttccgccgcggcgacggctgcgcctcggtccccgcggcctcccgcttcttctctcgggactcctgctacctctgtgccgcgccttcaacctagacgtggacagtcctgccgagtactctggccccgagggaagttacttcggcttcgccgtggatttcttcgtgcccagcgcgtcttcccggatgtttcttctcgtgggagctcccaaagcaaacaccacccagcctgggattgtggaaggagggcaggtcctcaaatgtgactggtcttctacccgccggtgccagccaattgaatttgatgcaacaggcaatagagattatgccaaggatgatccattggaatttaagtcccatcagtggtttggagcatctgtgaggtcgaaacaggataaaattttggcctgtgccccattgtaccattggagaactgagatgaaacaggagcgagagcctgttggaacatgctttcttcaagatggaacaaagactgttgagtatgctccatgtagatcacaagatattgatgctgatggacagggattttgtcaaggaggattcagcattgattttactaaagctgacagagtacttcttggtggtcctggtagcttttattggcaaggtcagcttatttcggatcaagtggcagaaatcgtatctaaatacgaccccaatgtttacagcatcaagtataataaccaattagcaactcggactgcacaagctatttttgatgacagctatttgggttattctgtggctgtcggagatttcaatggtgatggcatagatgactttgtttcaggagttccaagagcagcaaggactttgggaatggtttatatttatgatgggaagaacatgtcctccttatacaattttactggcgagcagatggctgcatatttcggattttctgtagctgccactgacattaatggagatgattatgcagatgtgtttattggagcacctctcttcatggatcgtggctctgatggcaaactccaagaggtggggcaggtctcagtgtctctacagagagcttcaggagacttccagacgacaaagctgaatggatttgaggtctttgcacggtttggcagtgccatagctcctttgggagatctggaccaggatggtttcaatgatattgcaattgctgctccatatgggggtgaagataaaaaaggaattgtttatatcttcaatggaagatcaacaggcttgaacgcagtcccatctcaaatccttgaagggcagtgggctgctcgaagcatgccaccaagctttggctattcaatgaaaggagccacagatatagacaaaaatggatatccagacttaattgtaggagcttttggtgtagatcgagctatcttatacagggccagaccagttatcactgtaaatgctggtcttgaagtgtaccctagcattttaaatcaagacaataaaacctgctcactgcctggaacagctctcaaagtttcctgttttaatgttaggttctgcttaaaggcagatggcaaaggagtacttcccaggaaacttaatttccaggtggaacttcttttggataaactcaagcaaaagggagcaattcgacgagcactgtttctctacagcaggtccccaagtcactccaagaacatgactatttcaagggggggactgatgcagtgtgaggaattgatagcgtatctgcgggatgaatctgaatttagagacaaactcactccaattactatttttatggaatatcggttggattatagaacagctgctgatacaacaggcttgcaacccattcttaaccagttcacgcctgctaacattagtcgacaggctcacattctacttgactgtggtgaagacaatgtctgtaaacccaagctggaagtttctgtagatagtgatcaaaagaagatctatattggggatgacaaccctctgacattgattgttaaggctcagaatcaaggagaaggtgcctacgaagctgagctcatcgtttccattccactgcaggctgatttcatcggggttgtccgaaacaatgaagccttagcaagactttcctgtgcatttaagacagaaaaccaaactcgccaggtggtatgtgaccttggaaacccaatgaaggctggaactcaactcttagctggtcttcgtttcagtgtgcaccagcagtcagagatggatacttctgtgaaatttgacttacaaatccaaagctcaaatctatttgacaaagtaagcccagttgtatctcacaaagttgatcttgctgttttagctgcagttgagataagaggagtctcgagtcctgatcatatctttcttccgattccaaactgggagcacaaggagaaccctgagactgaagaagatgttgggccagttgttcagcacatctatgagctgagaaacaatggtccaagttcattcagcaaggcaatgctccatcttcagtggccttacaaatataataataacactctgttgtatatccttcattatgatattgatggaccaatgaactgcacttcagatatggagatcaaccctttgagaattaagatctcatctttgcaaacaactgaaaagaatgacacggttgccgggcaaggtgagcgggaccatctcatcactaagcgggatcttgccctcagtgaaggagatattcacactttgggttgtggagttgctcagtgcttgaagattgtctgccaagttgggagattagacagaggaaagagtgcaatcttgtacgtaaagtcattactgtggactgagacttttatgaataaagaaaatcagaatcattcctattctctgaagtcgtctgcttcatttaatgtcatagagtttccttataagaatcttccaattgaggatatcaccaactccacattggttaccactaatgtcacctggggcattcagccagcgcccatgcctgtgcctgtgtgggtgatcattttagcagttctagcaggattgttgctactggctgttttggtatttgtaatgtacaggatgggcttttttaaacgggtccggccacctcaagaagaacaagaaagggagcagcttcaacctcatgaaaatggtgaaggaaactcagaaacttaactgcagtttttaagttatgctacatcttgacccactagaattagcaactttattatagatttaaactttcttcatgaggagtaaaaatccaaggctttactgctgatagtgctaattggcattaaccacaaaatgagaattatatttgtcaaccttctccttataaataagttcagacatacatttaataacatagggtgacttgtgtttttaggtatttaaataataaaatttcaagggatagtttttattcaatgtatataagacaggtagtgcctgatttactactttatataaaatagtacctccttcagttactgtttctgatttaatgtacggaactttatttgttgttgttgttgttgttgttgttgttgttttaaagcagtccaaatttggaccttagcaatcatgtcttttgtataggtacttaatgttaatacatattacactacagtttacttttcagaatactaaagactttataactgcatgaacttggatttttttaatcactcatatggtagaattttataaacacatacatgataccatccaaattcttgcttttaataacaaaggtacaatattttgttttagtatgaaaatctggtagatcctattacacttctgtttatattaaatccacaatattttattacatttttaacttgtataaattttaggtcaaatccttcaagccaacctatactaaaaattagttccataatcacaaatggctcttttgtgtaattgtttaatttcacctgaatatcataatgcttaaagccatatggagttggaaattatttccaaagcatatttattccattgttttagtctggctatttacagtataaaaaaagcattttattaaaatactgtgtagttctttgagatagttgcttatgcatatagtaagtattacattcttagagtagagcagagtttttagttagtattaatttattttcctccattcatgtacttttccttatatttccaaaactgttactgagaatgggtcaagatcagtgagaaatctttacagttgacaggaacctggaccccttaccccaactttatgagtaatgcttggaataaaaaactcttaaggcaactcactgatttacttctagcaatagcatgatgttacaggaatattacctctgtttaagcaaggtaatgtgtaaaatcagtctcggctgtcagaataacttctaaaaggtatttttataagcagttcaagttactgaaaaccttttaaacctttctgaagttcgttagtataaattacttttctaggattattaataaaagccacataggtggcaagttgtagttttatatggctctgtagagtggtgaaccttctagaggaatatatgatttattcacagttcctcaaggcctggggatgatgatcagttatacctatttttgtgcaattacatcatgttgtacattagaaatggagagtttaatagctctttaactgctgtcctcattaggtaatgataaatatttcccttaaataattgactattttgctgtgttttaaaaatgattgaaatttatcttgccatatctcataatttcatgcacaagttgactgagctaatcttgagaatatattcgtaaaataggagcacatttagttgaggtatacaaggtaggactctagacaaaaccttctattttagctttagtgaatttcaaaagtaatgggtcttggagtatagatttttattagtagcttgaaagagcttaatcatatgcagtaagtatttttattaccaataaatttaaaattttttaagaaaaatatttttatcctagggccaagtgttgcctgccaccaatcagtaagttagtctataacaaattttaccctaacagttttaccacctagcaacagtcatttctgaaaatatgttggatagaaagtcactctttggcaaaagtgttagaatttgcttttgtgccatctattccttttatggcatctatcttgaaagtaatcttgtattggagattgaaagatgctgtaatttagaaattaacatgatatcttaaattacctttatgaaatatagttttgtataatagcatagattttccttcaaaaaatgaacatttatatatctacaaaaatatggagaagagcaatttgaaagcctactttctgaagaaaatggtgggatttttttttatcatgattaaatatcaaaaaattgccctatgaaaactttaaatctctaaaacatttgaaatactaccatatttgtgatttattgagaataaaaatccattttgaaatgtaaaatttttatgatctgattcagttttaagaaaacatgaatgaactagaagatattaaaaacatttgacattggtaagaaatattgatactgatattgatttttatataggtatttatttcagaattgatattttgagaaaaatacatgtgagtcattttttctgtttctcttttctcttaacgattatcactgtaattctgaatct

SEQ ID NO: 125 - protein, 1048 aa, Homo sapiens
MAFPPRRRLRLGPRGLPLLLSGLLLPLCRAFNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSMPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLKQKGAIRRALFLYSRSPSHSKNMTISRGGLMQCEELIAYLRDESEFRDKLTPITIFMEYRLDYRTAADTTGLQPILNQFTPANISRQAHILLDCGEDNVCKPKLEVSVDSDQKKIYIGDDNPLTLIVKAQNQGEGAYEAELIVSIPLQADFIGVVRNNEALARLSCAFKTENQTRQVVCDLGNPMKAGTQLLAGLRFSVHQQSEMDTSVKFDLQIQSSNLFDKVSPVVSHKVDLAVLAAVEIRGVSSPDHIFLPIPNWEHKENPETEEDVGPVVQHIYELRNNGPSSFSKAMLHLQWPYKYNNNTLLYILHYDIDGPMNCTSDMEINPLRIKISSLQTTEKNDTVAGQGERDHLITKRDLALSEGDIHTLGCGVAQCLKIVCQVGRLDRGKSAILYVKSLLWTETFMNKENQNHSYSLKSSASFNVIEFPYKNLPIEDITNSTLVTTNVTWGIQPAPMPVPVWVIILAVLAGLLLLAVLVFVMYRMGFFKRVRPPQEEQEREQLQPHENGEGNSET

SEQ ID NO: 126 - DNA, 2397 bp, Homo sapiens
gcaagaactgaaacgaatggggattgaactgctttgcctgttctttctatttctaggaaggaatgatcacgtacaaggtggctgtgccctgggaggtgcagaaacctgtgaagactgcctgcttattggacctcagtgtgcctggtgtgctcaggagaattttactcatccatctggagttggcgaaaggtgtgataccccagcaaaccttttagctaaaggatgtcaattaaacttcatcgaaaaccctgtctcccaagtagaaatacttaaaaataagcctctcagtgtaggcagacagaaaaatagttctgacattgttcagattgcgcctcaaagcttgatccttaagttgagaccaggtggtgcgcagactctgcaggtgcatgtccgccagactgaggactacccggtggatttgtattacctcatggacctctccgcctccatggatgacgacctcaacacaataaaggagctgggctcccggctttccaaagagatgtctaaattaaccagcaactttagactgggcttcggatcttttgtggaaaaacctgtatcccctttcgtgaaaacaacaccagaagaaattgccaacccttgcagtagtattccatacttctgtttacctacatttggattcaagcacattttgccattgacaaatgatgctgaaagattcaatgaaattgtgaagaatcagaaaatttctgctaatattgacacacccgaaggtggatttgatgcaattatgcaagctgctgtgtgtaaggaaaaaattggctggcggaatgactccctccacctcctggtctttgtgagtgatgctgattctcattttggaatggacagcaaactagcaggcatcgtcattcctaatgacgggctctgtcacttggacagcaagaatgaatactccatgtcaactgtcttggaatatccaacaattggacaactcattgataaactggtacaaaacaacgtgttattgatcttcgctgtaacccaagaacaagttcatttatatgagaattacgcaaaacttattcctggagctacagtaggtctacttcagaaggactccggaaacattctccagctgatcatctcagcttatgaagaactgcggtctgaggtggaactggaagtattaggagacactgaaggactcaacttgtcatttacagccatctgtaacaacggtaccctcttccaacaccaaaagaaatgctctcacatgaaagtgggagacacagcttccttcagcgtgactgtgaatatcccacactgcgagagaagaagcaggcacattatcataaagcctgtggggctgggggatgccctggaattacttgtcagcccagaatgcaactgcgactgtcagaaagaagtggaagtgaacagctccaaatgtcaccacgggaacggctctttccagtgtggggtgtgtgcctgccaccctggccacatggggcctcgctgtgagtgtggcgaggacatgctgagcacagattcctgcaaggaggccccagatcatccctcctgcagcggaaggggtgactgctactgtgggcagtgtatctgccacttgtctccctatggaaacatttatgggccttattgccagtgtgacaatttctcctgcgtgagacacaaagggctgctctgcggaggtaacggcgactgtgactgtggtgaatgtgtgtgcaggagcggctggactggcgagtactgcaactgcaccaccagcacggactcctgcgtctctgaagatggagtgctctgcagcgggcgcggggactgtgtttgtggcaagtgtgtttgcacaaaccctggagcctcaggaccaacctgtgaacgatgtcctacctgtggtgacccctgtaactctaaacggagctgcattgagtgccacctgtcagcagctggccaagcccgagaagaatgtgtggacaagtgcaaactagctggtgcgaccatcagtgaagaagaagatttctcaaaggatggttctgtttcctgctctctgcaaggagaaaatgaatgtcttattacattcctaataactacagataatgaggggaaaaccatcattcacagcatcaatgaaaaagattgtccgaagcctccaaacattcccatgatcatgttaggggtttccctggctattcttctcatcggggttgtcctactgtgcatctggaagctactggtgtcatttcatgatcgtaaagaagttgccaaatttgaagcagaacgatcaaaagccaagtggcaaacgggaaccaatccactctacagaggatccacaagtacttttaaaaatgtaacttataaacacagggaaaaacaaaaggtagacctttccacagattgctagaactactttatgca

SEQ ID NO: 127 - protein, 788 aa, Homo sapiens
MGIELLCLFFLFLGRNDHVQGGCALGGAETCEDCLLIGPQCAWCAQENFTHPSGVGERCDTPANLLAKGCQLNFIENPVSQVEILKNKPLSVGRQKNSSDIVQIAPQSLILKLRPGGAQTLQVHVRQTEDYPVDLYYLMDLSASMDDDLNTIKELGSRLSKEMSKLTSNFRLGFGSFVEKPVSPFVKTTPEEIANPCSSIPYFCLPTFGFKHILPLTNDAERFNEIVKNQKISANIDTPEGGFDAIMQAAVCKEKIGWRNDSLHLLVFVSDADSHFGMDSKLAGIVIPNDGLCHLDSKNEYSMSTVLEYPTIGQLIDKLVQNNVLLIFAVTQEQVHLYENYAKLIPGATVGLLQKDSGNILQLIISAYEELRSEVELEVLGDTEGLNLSFTAICNNGTLFQHQKKCSHMKVGDTASFSVTVNIPHCERRSRHIIIKPVGLGDALELLVSPECNCDCQKEVEVNSSKCHHGNGSFQCGVCACHPGHMGPRCECGEDMLSTDSCKEAPDHPSCSGRGDCYCGQCICHLSPYGNIYGPYCQCDNFSCVRHKGLLCGGNGDCDCGECVCRSGWTGEYCNCTTSTDSCVSEDGVLCSGRGDCVCGKCVCTNPGASGPTCERCPTCGDPCNSKRSCIECHLSAAGQAREECVDKCKLAGATISEEEDFSKDGSVSCSLQGENECLITFLITTDNEGKTIIHSINEKDCPKPPNIPMIMLGVSLAILLIGVVLLCIWKLLVSFHDRKEVAKFEAERSKAKWQTGTNPLYRGSTSTFKNVTYKHREKQKVDLSTDC

SEQ ID NO: 128 - DNA, 3036 bp, Homo sapiens
cgaccagcagaccagacagtcacagcagccttgacaaaacgttcctggaactcaagcacttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccatgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggataatattttcataattttttatttgaaattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtatgacagaatacatttgaaaacattggttatattaccaagactttgactagaatgtcgtat

SEQ ID NO: 129 - protein, 702 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 130 - DNA, 90 bp, Homo sapiens
ttggctttggtcttcaagtagccaaagcgatgaaatatcttgcaagcaaaaagtttgtccacagagacttggctgcaagaaactgtatgt

SEQ ID NO: 131 - protein, 22 aa, Homo sapiens
KAMKYLASKKFVHRDLAARNCM

SEQ ID NO: 132 - DNA, 1804 bp, Homo sapiens
cgctccacctctcaagcagccagcgcctgcctgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccggccccgggctccaccgcccccccagcccatggtgtcacctcggccccggacaacaggcccgccttgggctccaccgcccctccagtccacaatgtcacctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgcccgctgagctgagtggccagccagtgccattccactccactcaggttcttcagggccagagcccctgcaccctgtttgggctggtgagctgggagttcaggtgggctgctcacaccgtccttcagaggccccaccaatttctcggacacttctcagtgtgtggaagctcatgtgggcccctgaggctcatgcctgggaagtgttgtggtgggggctcccaggaggactggcccagagagccctgagatagcggggatcctgaactggactgaataaaacgtggtctcccactg

SEQ ID NO: 133 - protein, 475 aa, Homo sapiens
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSTVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 134 - DNA, 1552 bp, Homo sapiens
gcccgtacacaccgtgtgctgggacaccccacagtcagccgcatggctcccctgtgccccagcccctggctccctctgttgatcccggcccctgctccaggcctcactgtgcaactgctgctgtcactgctgcttctgatgcctgtccatccccagaggttgccccggatgcaggaggattcccccttgggaggaggctcttctggggaagatgacccactgggcgaggaggatctgcccagtgaagaggattcacccagagaggaggatccacccggagaggaggatctacctggagaggaggatctacctggagaggaggatctacctgaagttaagcctaaatcagaagaagagggctccctgaagttagaggatctacctactgttgaggctcctggagatcctcaagaaccccagaataatgcccacagggacaaagaaggggatgaccagagtcattggcgctatggaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtgtgcaactgaccctgcctcctgggctagagatggctctgggtcccgggcgggagtaccgggctctgcagctgcatctgcactggggggctgcaggtcgtccgggctcggagcacactgtggaaggccaccgtttccctgccgagatccacgtggttcacctcagcaccgcctttgccagagttgacgaggccttggggcgcccgggaggcctggccgtgttggccgcctttctggaggagggcccggaagaaaacagtgcctatgagcagttgctgtctcgcttggaagaaatcgctgaggaaggctcagagactcaggtcccaggactggacatatctgcactcctgccctctgacttcagccgctacttccaatatgaggggtctctgactacaccgccctgtgcccagggtgtcatctggactgtgtttaaccagacagtgatgctgagtgctaagcagctccacaccctctctgacaccctgtggggacctggtgactctcggctacagctgaacttccgagcgacgcagcctttgaatgggcgagtgattgaggcctccttccctgctggagtggacagcagtcctcgggctgctgagccagtccagctgaattcctgcctggctgctggtgacatcctagccctggtttttggcctcctttttgctgtcaccagcgtcgcgttccttgtgcagatgagaaggcagcacagaaggggaaccaaagggggtgtgagctaccgcccagcagaggtagccgagactggagcctagaggctggatcttggagaatgtgagaagccagccagaggcatctgagggggagccggtaactgtcctgtcctgctcattatgccacttccttttaactgccaagaaattttttaaaataaatatttataat

SEQ ID NO: 135 - protein, 459 aa, Homo sapiens
MAPLCPSPWLPLLIPAPAPGLTVQLLLSLLLLMPVHPQRLPRMQEDSPLGGGSSGEDDPLGEEDLPSEEDSPREEDPPGEEDLPGEEDLPGEEDLPEVKPKSEEEGSLKLEDLPTVEAPGDPQEPQNNAHRDKEGDDQSHWRYGGDPPWPRVSPACAGRFQSPVDIRPQLAAFCPALRPLELLGFQLPPLPELRLRNNGHSVQLTLPPGLEMALGPGREYRALQLHLHWGAAGRPGSEHTVEGHRFPAEIHVVHLSTAFARVDEALGRPGGLAVLAAFLEEGPEENSAYEQLLSRLEEIAEEGSETQVPGLDISALLPSDFSRYFQYEGSLTTPPCAQGVIWTVFNQTVMLSAKQLHTLSDTLWGPGDSRLQLNFRATQPLNGRVIEASFPAGVDSSPRAAEPVQLNSCLAAGDILALVFGLLFAVTSVAFLVQMRRQHRRGTKGGVSYRPAEVAETGA

SEQ ID NO: 136 - DNA, 1595 bp, Homo sapiens
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacaggtttgagctgaattatcacatgaatataaatgggaaatcagtgttttagagagagaacttttcgacatatttcctgttcccttggaataaaaacatttcttctgaaattttaccgttaaaaaaaaaaaaaaaaaaaaaaaaa

SEQ ID NO: 137 - protein, 405 aa, Homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGLS

SEQ ID NO: 138 - DNA, 1437 bp, Homo sapiens
gcttcctcagacatgccgctgctgctactgctgcccctgctgtgggcaggggccctggctatggatccaaatttctggctgcaagtgcaggagtcagtgacggtacaggagggtttgtgcgtcctcgtgccctgcactttcttccatcccataccctactacgacaagaactccccagttcatggttactggttccgggaaggagccattatatccggggactctccagtggccacaaacaagctagatcaagaagtacaggaggagactcagggcagattccgcctccttggggatcccagtaggaacaactgctccctgagcatcgtagacgccaggaggagggataatggttcatacttctttcggatggagagaggaagtaccaaatacagttacaaatctccccagctctctgtgcatgtgacagacttgacccacaggcccaaaatcctcatccctggcactctagaacccggccactccaaaaaccttacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagaccagagcaggactggttcatggggccattggaggagctggtgttacagccctgctcgctctttgtctctgcctcatcttcttcatagtgaagacccacaggaggaaagcagccaggacagcagtgggcagcaatgacacccaccctaccacagggtcagcctccccgaaacaccagaagaactccaagttacatggccccactgaaacctcaagctgttcaggtgccgcccctactgtggagatggatgaggagctgcattatgcttccctcaactttcatgggatgaatccttccaaggacacctccaccgaatactcagaggtcaggacccagtgaggaaccctcaagagcatcaggctcagctagaagatccacatcctctacaggtcggggaccaaaggctgattcttggagatttaactccccacaggcaatgggtttatagacattatgtgagtttcctgctatattaacatcatcttgagactttgcaagcagagagtcgtggaatcaaatctgtgctctttcatttgctaagtgtatgatgtcacacaagctccttaaccttccatgtctccattttcttctctgtgaagtaggtataagaagtcctatctcatagggatgctgtgagcattaaataaaggtacacatggaaaacaccag

SEQ ID NO: 139 - protein, 364 aa, Homo sapiens
MPLLLLLPLLWAGALAMDPNFWLQVQESVTVQEGLCVLVPCTFFHPIPYYDKNSPVHGYWFREGAIISGDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGLVHGAIGGAGVTALLALCLCLIFFIVKTHRRKAARTAVGSNDTHPTTGSASPKHQKNSKLHGPTETSSCSGAAPTVEMDEELHYASLNFHGMNPSKDTSTEYSEVRTQ

SEQ ID NO: 140 - DNA, 1968 bp, Homo sapiens
aggcccctgcctgccccagcatcccctgcgcgaagctgggtgccccggagagtctgaccaccatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgactgaccccaccaggagattcttcaaagtgacgcctcccccaggaagcgggccccagaaccagtacgggaacgtgctgtctctccccacacccacctcaggcctcggacgcgcccagcgttgggccgcaggcctggggggcactgccccgtcttatggaaacccgagcagcgacgtccaggcggatggagccttggggtcccggagcccgccgggagtgggcccagaagaagaggaaggggagggctatgaggaacctgacagtgaggaggactccgagttctatgagaacgactccaaccttgggcaggaccagctctcccaggatggcagcggctacgagaaccctgaggatgagcccctgggtcctgaggatgaagactccttctccaacgctgagtcttatgagaacgaggatgaagagctgacccagccggtcgccaggacaatggacttcctgagccctcatgggtcagcctgggaccccagccgggaagcaacctccctggcagggtcccagtcctatgaggatatgagaggaatcctgtatgcagccccccagctccgctccattcggggccagcctggacccaatcatgaggaagatgcagactcttatgagaacatggataatcccgatgggccagacccagcctggggaggagggggccgcatgggcacctggagcaccaggtgatcctcaggtggccagcctggatctcctcaagtccccaagattcacacctgactctgaaatctgaagacctcgagcagatgatgccaacctctggagcaatgttgcttaggatgtgtgcatgtgtgtaagtgtgtgtgtgtgtgtgtgtgtgtatacatgccagtgacacttccagtcccctttgtattccttaaataaactcaatgagctcttccaatcctaaaaaaaaaaa

SEQ ID NO: 141 - protein, 557 aa, Homo sapiens
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMTDPTRRFFKVTPPPGSGPQNQYGNVLSLPTPTSGLGRAQRWAAGLGGTAPSYGNPSSDVQADGALGSRSPPGVGPEEEEGEGYEEPDSEEDSEFYENDSNLGQDQLSQDGSGYENPEDEPLGPEDEDSFSNAESYENEDEELTQPVARTMDFLSPHGSAWDPSREATSLAGSQSYEDMRGILYAAPQLRSIRGQPGPNHEEDADSYENMDNPDGPDPAWGGGGRMGTWSTR

SEQ ID NO: 142 - DNA, 3216 bp, Homo sapiens
ggcagtttcctggctgaacacgccagcccaatacttaaagagagcaactcctgactccgatagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccaggtcactgcagggaacctccaccatgggaaaatgaagccacagagagaatttatcatttcgtggtggggcagatggtttattatcagtgcgtccagggatacagggctctacacagaggtcctgctgagagcgtctgcaaaatgacccacgggaagacaaggtggacccagccccagctcatatgcacaggtgaaatggagaccagtcagtttccaggtgaagagaagcctcaggcaagccccgaaggccgtcctgagagtgagacttcctgcctcgtcacaacaacagattttcaaatacagacagaaatggctgcaaccatggagacgtccatatttacaacagagtaccaggtagcagtggccggctgtgttttcctgctgatcagcgtcctcctcctgagtgggctcacctggcagcggagacagaggaagagtagaagaacaatctagaaaaccaaaagaacaagaatttcttggtaagaagccgggaacagacaacagaagtcatgaagcccaagtgaaatcaaaggtgctaaatggtcgcccaggagacatccgttgtgcttgcctgcgttttggaagctctgaagtcacatcacaggacacggggcagtggcaaccttgtctctatgccagctcagtcccatcagagagcgagcgctacccacttctaaatagcaatttcgccgttgaagaggaagggcaaaaccactagaactctccatcttattttcatgtatatgtgttcattaaagcatgaatggtatggaactctctccaccctatatgtagtataaagaaaagtaggtttacattcatctcattccaacttcccagttcaggagtcccaaggaaagccccagcactaacgtaaatacacaacacacacactctaccctatacaactggacattgtctgcgtggttcctttctcagccgcttctgactgctgattctcccgttcacgttgcctaataaacatccttcaagaactctgggctgctacccagaaatcattttacccttggctcaatcctctaagctaacccccttctactgagccttcagtcttgaatttctaaaaaacagaggccatggcagaataatctttgggtaacttcaaaacggggcagccaaacccatgaggcaatgtcaggaacagaaggatgaatgaggtcccaggcagagaatcatacttagcaaagttttacctgtgcgttactaattggcctctttaagagttagtttctttgggattgctatgaatgataccctgaatttggcctgcactaatttgatgtttacaggtggacacacaaggtgcaaatcaatgcgtacgtttcctgagaagtgtctaaaaacaccaaaaagggatccgtacattcaatgtttatgcaaggaaggaaagaaagaaggaagtgaagagggagaagggatggaggtcacactggtagaacgtaaccacggaaaagagcgcatcaggcctggcacggtggctcaggcctataaccccagctccctaggagaccaaggcgggagcatctcttgaggccaggagtttgagaccagcctgggcagcatagcaagacacatccctacaaaaaattagaaattggctggatgtggtggcatacgcctgtagtcctagccactcaggaggctgaggcaggaggattgcttgagcccaggagttcgaggctgcagtcagtcatgatggcaccactgcactccagcctgggcaacagagcaagatcctgtctttaaggaaaaaaagacaagatgagcataccagcagtccttgaacattatcaaaaagttcagcatattagaatcaccgggaggccttgttaaaagagttcgctgggcccatcttcagagtctctgagttgttggtctggaatagagccaaatgttttgtgtgtctaacaattcccaggtgctgttgctgctgctactattccaggaacacactttgagaaccattgtgttattgctctgcacgcccacccactctcaactcccacgaaaaaaatcaacttccagagctaagatttcggtggaagtcctggttccatatctggtgcaagatctcccctcacgaatcagttgagtcaacattctagctcaacaacatcacacgattaacattaacgaaaattattcatttgggaaactatcagccagttttcacttctgaaggggcaggagagtgttatgagaaatcacggcagttttcagcagggtccagattcagattaaataactattttctgtcatttctgtgaccaaccacatacaaacagactcatctgtgcactctccccctcccccttcaggtatatgttttctgagtaaagttgaaaagaatctcagaccagaaaatatagatatatatttaaatcttacttgagtagaactgattacgacttttgggtgttgaggggtctataagatcaaaacttttccatgataatactaagatgttatcgaccatttatctgtccttctctcaaaagtgtatggtggaattttccagaagctatgtgatacgtgatgatgtcatcactctgctgttaacatataataaatttattgctattgtttataaaagaataaatgatatttttt

SEQ ID NO: 143 - protein, 272 aa, Homo sapiens
MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQVAVAGCVFLLISVLLLSGLTWQRRQRKSRRTI

SEQ ID NO: 144 - DNA, 3227 bp, Homo sapiens
gctgggcaaagccggtggcaagggcctcccctgccgctgtgccaggcaggcagtgccaaatccggggagcctggagctggggggagggccggggacagcccggccctgccccctcccccgctgggagcccagcaacttctgaggaaagtttggcacccatggcgtggcggtgccccaggatgggcagggtcccgctggcctggtgcttggcgctgtgcggctgggcgtgcatggcccccaggggcacgcaggctgaagaaagtcccttcgtgggcaacccagggaatatcacaggtgcccggggactcacgggcacccttcggtgtcagctccaggttcagggagagccccccgaggtacattggcttcgggatggacagatcctggagctcgcggacagcacccagacccaggtgcccctgggtgaggatgaacaggatgactggatagtggtcagccagctcagaatcacctccctgcagctttccgacacgggacagtaccagtgtttggtgtttctgggacatcagaccttcgtgtcccagcctggctatgttgggctggagggcttgccttacttcctggaggagcccgaagacaggactgtggccgccaacacccccttcaacctgagctgccaagctcagggacccccagagcccgtggacctactctggctccaggatgctgtccccctggccacggctccaggtcacggcccccagcgcagcctgcatgttccagggctgaacaagacatcctctttctcctgcgaagcccataacgccaagggggtcaccacatcccgcacagccaccatcacagtgctcccccagcagccccgtaacctccacctggtctcccgccaacccacggagctggaggtggcttggactccaggcctgagcggcatctaccccctgacccactgcaccctgcaggctgtgctgtcagacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggagtgcccctgggcccccctaagaacattagtgctacgcggaatgggagccaggccttcgtgcattggcaagagccccgggcgcccctgcagggtaccctgttagggtaccggctggcgtatcaaggccaggacaccccagaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccagtgaaggaaccttcaactcctgccttctcgtggccctggtggtatgtactgctaggagcagtcgtggccgctgcctgtgtcctcatcttggctctcttccttgtccaccggcgaaagaaggagacccgttatggagaagtgtttgaaccaacagtggaaagaggtgaactggtagtcaggtaccgcgtgcgcaagtcctacagtcgtcggaccactgaagctaccttgaacagcctgggcatcagtgaagagctgaaggagaagctgcgggatgtgatggtggaccggcacaaggtggccctggggaagactctgggagagggagagtttggagctgtgatggaaggccagctcaaccaggacgactccatcctcaaggtggctgtgaagacgatgaagattgccatctgcacgaggtcagagctggaggatttcctgagtgaagcggtctgcatgaaggaatttgaccatcccaacgtcatgaggctcatcggtgtctgtttccagggttctgaacgagagagcttcccagcacctgtggtcatcttacctttcatgaaacatggagacctacacagcttcctcctctattcccggctcggggaccagccagtgtacctgcccactcagatgctagtgaagttcatggcagacatcgccagtggcatggagtatctgagtaccaagagattcatacaccgggacctggcggccaggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacaatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctgagacaaccctccacctggtactccctctcaggatccaagctaagcactgccactggggaaaactccaccttcccacttttccaccccacgccttatccccacttgcagccctgtcttcctacctatcccacctccatcccagacaggtccctccccttctctgtgcagtagcatcaccttgaaagcagtagcatcaccatctgtaaaaggaaggggttggattgcaatatctgaagccctcccaggtgttaacattccaagactctagagtccaaggtttaaagagtctagattcaaaggttctaggtttcaaagatgctgtgagtctttggttctaaggacctgaaattccaaagtctctaattctattaaagtgctaaggttctaaggcaaaaaaaaaaaaaaaaaaaaa

SEQ ID NO: 145 - protein, 885 aa, Homo sapiens [sequence omitted]

SEQ ID NO: 146 - DNA, 3630 bp, Homo sapiens
atacgggagaactaaggctgaaacctcggaggaacaaccacttttgaagtgacttcgcggcgtgcgttgggtgcggactaggtggccccggcgggagtgtgctggagcctgaagtccacgcgcgcggctgagaaccgccgggaccgcacgtgggcgccgcgcgcttcccccgcttcccaggtgggcgccggccgccaggccacctcacgtccggccccggggatgcgcgtcctcctcgccgcgctgggactgctgttcctgggggcgctacgagccttcccacaggatcgacccttcgaggacacctgtcatggaaaccccagccactactatgacaaggctgtcaggaggtgctgttaccgctgccccatggggctgttcccgacacagcagtgcccacagaggcctactgactgcaggaagcagtgtgagcctgactactacctggatgaggccgaccgctgtacagcctgcgtgacttgttctcgagatgacctcgtggagaagacgccgtgtgcatggaactcctcccgtgtctgcgaatgtcgacccggcatgttctgttccacgtctgccgtcaactcctgtgcccgctgcttcttccattctgtctgtccggcagggatgattgtcaagttcccaggcacggcgcagaagaacacggtctgtgagccggcttccccaggggtcagccctgcctgtgccagcccagagaactgcaaggaaccctccagtggcaccatcccccaggccaagcccaccccggtgtccccagcaacctccagtgccagcaccatgcctgtaagagggggcacccgcctcgcccaggaagctgcttctaaactgacgagggctcccgactctccctcctctgtgggaaggcctagttcagatccaggtctgtccccaacacagccatgcccagaggggtctggtgattgcagaaagcagtgtgagcccgactactacctggacgaggccggccgctgcacagcctgcgtgagctgttctcgagatgaccttgtggagaagacgccatgtgcatggaactcctcccgcacctgcgaatgtcgacctggcatgatctgtgccacatcagccaccaactcctgtgcccgctgtgtcccctacccaatctgtgcagcagagacggtcaccaagccccaggatatggctgagaaggacaccacctttgaggcgccacccctggggacccagccggactgcaaccccaccccagagaatggcgaggcgcctgccagcaccagccccactcagagcttgctggtggactcccaggccagtaagacgctgcccatcccaaccagcgctcccgtcgctctctcctccacggggaagcccgttctggatgcagggccagtgctcttctgggtgatcctggtgttggttgtggtggtcggctccagcgccttcctcctgtgccaccggagggcctgcaggaagcgaattcggcagaagctccacctgtgctacccggtccagacctcccagcccaagctagagcttgtggattccagacccaggaggagctcaacgcagctgaggagtggtgcgtcggtgacagaacccgtcgcggaagagcgagggttaatgagccagccactgatggagacctgccacagcgtgggggcagcctacctggagagcctgccgctgcaggatgccagcccggccgggggcccctcgtcccccagggaccttcctgagccccgggtgtccacggagcacaccaataacaagattgagaaaatctacatcatgaaggctgacaccgtgatcgtggggaccgtgaaggctgagctgccggagggccggggcctggcggggccagcagagcccgagttggaggaggagctggaggcggaccataccccccactaccccgagcaggagacagaaccgcctctgggcagctgcagcgatgtcatgctctcagtggaagaggaagggaaagaagaccccttgcccacagctgcctctggaaagtgaggcctgggctgggctggggctaggagggcagcagggtggcctctgggaggccaggatggcactgttggcaccgaggttgggggcagaggcccatctggcctgaactgaggctccagcatctagtggtggaccggccggtcactgcaggggtctggtggtctctgcttgcatccccaacttagctgtcccctgacccagagcctaggggatccggggcttgtacagaagagacagtccaaggggactggatcccagcagtgatgttggttgaggcagcaaacagatggcaggatgggcactgccgagaacagcattggtcccagagccctgggcatcagaccttaaccaccaggcccacagcccagcgagggagaggtcgtgaggccagctcccggggcccctgtaaccctactctcctctctccctggacctcagaggtgacacccattgggcccttccggcatgcccccagttactgtaaatgtggcccccagtgggcatggagccagtgcctgtggttgtttctccagagtcaaaagggaagtcgagggatggggcgtcgtcagctggcactgtctctgctgcagcggccacactgtactctgcactggtgtgagggcccctgcctggactgtgggaccctcctggtgctgcccaccttccctgtcctgtagccccctcggtgggcccagggcctaggggcccaggatcaagtcactcatctcagaatgtccccaccaatccccgccacagcaggcgcctcgggtcccagatgtctgcagccctcagcagctgcagaccgcccctcaccaacccagagaacctgctttactttgcccagggacttcctccccatgtgaacatggggaacttcgggccctgcctggagtccttgaccgctctctgtgggccccacccactctgtcctgggaaatgaagaagcatcttccttaggtctgccctgcttgcaaatccactagcaccgaccccaccacctggttccggctctgcacgctttggggtgtggatgtcgagaggcaccacggcctcacccaggcatctgctttactctggaccataggaaacaagaccgtttggaggtttcatcaggattttgggtttttcacatttcacgctaaggagtagtggccctgacttccggtcggctggccagctgactccctagggccttcagacgtgtatgcaaatgagtgatggataaggatgagtcttggagttgcgggcagcctggagactcgtggacttaccgcctggaggcaggcccgggaaggctgctgtttactcatcgggcagccacgtgctctctggaggaagtgatagtttctgaaaccgctcagatgttttggggaaagttggagaagccgtggccttgcgagaggtggttacaccagaacctggacattggccagaagaagcttaagtgggcagacactgtttgcccagtgtttgtgcaaggatggagtgggtgtctctgcatcacccacagccgcagctgtaaggcacgctggaaggcacacgcctgccaggcagggcagtctggcgcccatgatgggagggattgacatgtttcaacaaaataatgcacttccttaaaaaaaa

SEQ ID NO: 147 - protein, 595 aa, Homo sapiens
MRVLLAALGLLFLGALRAFPQDRPFEDTCHGNPSHYYDKAVRRCCYRCPMGLFPTQQCPQRPTDCRKQCEPDYYLDEADRCTACVTCSRDDLVEKTPCAWNSSRVCECRPGMFCSTSAVNSCARCFFHSVCPAGMIVKFPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSCARCVPYPICAAETVTKPQDMAEKDTTFEAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 148 - DNA, 3802 bp, Homo sapiens
  misc_feature (1064)..(1065): n is a, c, g, or t
  misc_feature (1240)..(1240): n is a, c, g, or t
  misc_feature (1862)..(1862): n is a, c, g, or t
  misc_feature (1878)..(1878): n is a, c, g, or t
  misc_feature (1899)..(1900): n is a, c, g, or t
  misc_feature (1906)..(1906): n is a, c, g, or t
  misc_feature (1917)..(1917): n is a, c, g, or t
  misc_feature (1928)..(1929): n is a, c, g, or t
  misc_feature (2395)..(2395): n is a, c, g, or t
cccctgcagctggcctcaatgttaagatcttaaggggcacagcacagaccttgtcttgtctatctccctggcacctctcacagagtacagcttattaacagatgttccagaaactgttactgaacaatcggcttgatgctgtgggcttgtctgcatcttgcaactgtcacctggctgagaaatttcttctataaataagcagtttctgtttcagatgtgatatgccctgatatttacaccctgtctcttaccccatccaagactcaaacttagaaacttgaattagatgtggtattcaaatccttacgtgccgcgaagacacagacagcccccgtaagaacccacgaagcaggcgaagttcattgttctcaacattctagctgctcttgctgcatttgctctggaattcttgtagagatattacttgtccttccaggctgttctttctgtagctcccttgttttctttttgtgatcatgttgcagatggctgggcagtgctcccaaaatgaatattttgacagtttgttgcatgcttgcataccttgtcaacttcgatgttcttctaatactcctcctctaacatgtcagcgttattgtaatgcaagtaagtaatattgcttgaacgattattcattggtgtgaactattctgtctatatggactgcttattcagagaatcaacataatgggcatgatggtgagttttcttgaatcaaaaagagaaaggaagcaaggcagtgattttaatgtttatggaaacaaagtaattatttggaactgaacttgatatgattcagcactattagcaacatagattttttttaaaaatcagctcttctaattaagtgatatttagaatttaaaagtcaatgttcattaattaaggtgattgaatggaaataatccatacttgattattttgctatcaaaacaatccataattcattatttttagcaaaataatcaagtatgacagccgggtgcggtggatggctcacacctgtaatcccagcactttgggaggccgagatgggtgaatcacctgaggtcggcagtttgagnncagcctggccaacctggtgaaaccctgtctctactaaaaatacaaaaaattagctgggcatggtggcacaggtctgtaatcccagctactcgggaggctgaggcaggagaatcgtttgaacttgggaggtggaggttgcagtgagccgagatcgcgccactgcaactctagcctnggcaacagagcaagactttgtctcaaaataaataaataaataataacaataaagtatgtgaatattatgttatcagctcattatctgtctgatgttcttttcataaaggtgtgaccaattcagtgaaaggaacgaatgcgattctctggacctgtttgggactgagcttaataatttctttggcagttttcgtgctaatgtttttgctaaggaagataagctctgaaccattaaaggacgagtttaaaaacacaggttggtttgatggtgaatctttgaaatctatttccaggggatggctattgtgagtttcagttccttttctttttttagcgttgactatttcacttcgttacagccctttcgaatgtgttagaacattgttacattaaatgaacttggtagaggtgagccatcttcattctgattttgacaccttggcagattttctacaatgtcagtcttctccaggattcttccactgttaattactctattgaaagtactaaggctttcttgggaaacatcagtctctttgactaaagttagcacatcgattaaatgccacattatcagaaactcctagccaggtctgctactgtcaggaaaagcatatttgtcnagatctatggtcakgnttttatacaaatataggtgtnnyttgcntgagtgaacantttactactgnnaaaatgttagaaatgaataaccagttgctcctgaattatttgaggaatcatctaaaaaataattatttttaagcaatagagaaccagtcccagaaaaatgaatgttctacttaagtgcctcttaagataaaaaatacttctgcagcacctttgctcatgattggattcccaagcatgtacagccactgccctatttctgtatgcatttatttatttatttatttatttatttatttagagatggagtctcgctctgtggcccaaggctggagtgcagtggcgtgatctcaactcactgcagcctctgcctcttgggttcaaacaattctcccatctcagcctcctgagtaactggactataggtatgtgccatcacctccgactaatttttgtactttttggtagagacagggtttcatcatgttggccaggatggtctcaagctcctgaccacaagtgatctgcncgcctcagcttcccaaagtgctgggattacaggcgtgagccacagggcccagcacatactcattcttttttactgaaaagatctgtttcaagctgggtgttggtggctatggagctgtagtccgactgctctgtaggctaacgtgggaggattgcttgagcccagagtttgaatgcagcctgggcaacacagtaagaccccacctctaaaaaatgaaaaaatctctctcacattgctttgagtcccgatgtgtactgctaagactctcatgaccacattctctgtgaagtttgggttaagttccgttctacataattaggatcaggtctcctgggcatggctaacattgacctggaaaagagcaggactggtgatgaaattattcttccgagaggcctcgagtacacggtggaagaatgcacctgtgaagactgcatcaagagcaaaccgaaggtcgactctgaccattgctttccactcccagctatggaggaaggcgcaaccattcttgtcaccacgaaaacgaatgactattgcaagagcctgccagctgctttgagtgctacggagatagagaaatcaatttctgctaggtaattaaccatttcgactcgagcagtgccactttaaaaatcttttgtcagaatagatgatgtgtcagatctctttaggatgactgtatttttcagttgccgatacagctttttgtcctctaactgtggaaactctttatgttagatatatttctctaggttactgttgggagcttaatggtagaaacttccttggtttcatgattaaagtctttttttttcctgacatctaagtttttattaacgtgagtttttaaaaacaagcatgtataccagtgtggggggtgagggtgggagagaaaggtgggagggggaaagaattctaacctattgataataaagctccagttttggccaggcgcggtgctcatgcctgtaatcccagcactttgaaaggccgaggcgggcagattacctgaggtcaggaatttgagaccagcctggccaacatggtgaaaccctgtctttactaaaaatacaaaaattagctgggcatggtggtaggcacctgtaatcccagctactcaggaggctgaggcaggagaatcgcttgaacctgggaggtggaggttgcaatgagctgagatagcatccctgcactccagcctgggcaagagggtgagactccgtctcaaaacaaaacaacacaaacaaacaaaaagtacctccagcttcatcttctgctggattttatagcgcccccaaagatatgtggtccttaaaaattgtataccacttattcaggagtcttgttcctgaaagggttgttcttgttacagccctagtctgggctgtaatcagcttcttaaggtcc

SEQ ID NO: 149 - protein, 184 aa, Homo sapiens [sequence omitted]

SEQ ID NO: 150 - DNA, 2607 bp, Homo sapiens
tctgttcccacttcctccccgccccaggaaacctgccatggcctcctggtgagctgtcctcatccactgctcgctgcctctccagatcttcagttgcttcaggccatttgaacgtatatgagccggtcgtaggggatatgatggcttagcttgggctcagaggcctgaaaatcgcccccaccaatcacctgtttcccccaatctaccctcctgaaggtcactgacaaagacttcattgtctcctaggagaggctgccatatatccagggctgacgtaattccatcttaatatcagttacattataaaaatttacctcgtgcctgaggccccagagcccaagggtgcaaagcagtaattggtcaaagttcaacttccctcccactctgggctcaggctgtcccctgagggcctgtgttttgagtctctttccagaaccttggtgtgaacttaggtcttggcgtcgggatcccttttcgtcacactcaggtgacctacagggagctccgctcgacactgcaaggcttagaccagttcggtccaacagagaaagcaggcaaccaccatgtcatttgaaaacagtttcatcgggatataattcgcaacccatacagtgaatccatttaagatactctgacccatggatcccctgggtgcagccaagccacaatggccatggcgccgctgtctggccgcactgctatttcagctgctggtggctgtgtgtttcttctcctacctgcgtgtgtcccgagacgatgccactggatcccctagggctcccagtgggtcctcccgacaggacaccactcccacccgccccaccctcctgatcctgctatggacatggcctttccacatccctgtggctctgtcccgctgttcagagatggtgcccggcacagccgactgccacatcactgccgaccgcaaggtgtacccacaggcagacacggtcatcgtgcaccactgggatatcatgtccaaccctaagtcacgcctcccaccttccccgaggccgcaggggcagcgctggatctggttcaacttggagccaccccctaactgccagcacctggaagccctggacagatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcagccagggtgcgctactaccagagcctgcaggctcatctcaaggtggacgtgtacggacgctcccacaagcccctgcccaaggggaccatgatggagacgctgtcccggtacaagttctacctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactggatttctgcaaggcctgctggaaactgcagcaggaatccaggtaccagacggtgcgcagcatagcggcttggttcacctgagaggccggcatggtgcctgggctgccgggaacctcatctgcctggggcctcacctgctggagtcctttgtggccaaccctctctcttacctgggacctcacacgctgggcttcacggctgccaggagcctctcccctccagaagacttgcctgctagggacctcgcctgctggggacctcgcctgttggggacctcacctgctggggacctcacctgctggggaccttggctgctggaggctgcacctactgaggatgtcggcggtcggggactttacctgctgggacctgctcccagagaccttgccacactgaatctcacctgctggggacctcaccctggagggccctgggccctggggaactggcttacttggggccccacccgggagtgatggttctggctgatttgtttgtgatgttgttagccgcctgtgaggggtgcagagagatcatcacggcacggtttccagatgtaatactgcaaggaaaaatgatgacgtgtctcctcactctagaggggttggtcccatgggttaagagctcaccccaggttctcacctcaggggttaagagctcagagttcagacaggtccaagttcaagcccaggaccaccacttatagggtacaggtgggatcgactgtaaatgaggacttctggaacattccaaatattctggggttgagggaaattgctgctgtctacaaaatgccaagggtggacaggcgctgtggctcacgcctgtaatcccagcactttgggaggctgaggtaggaggattgattgaggccaagagttaaagaccagcctggtcaatatagcaagaccacgtctctaaataaaaaataataggccggccaggcaaaaaaaaaaaaaaaaaa

SEQ ID NO: 151 - protein, 361 aa, Homo sapiens
MDPLGAAKPQWPWRRCLAALLFQLLVAVCFFSYLRVSRDDATGSPRAPSGSSRQDTTPTRPTLLILLWTWPFHIPVALSRCSEMVPGTADCHITADRKVYPQADTVIVHHWDIMSNPKSRLPPSPRPQGQRWIWFNLEPPPNCQHLEALDRYFNLTMSYRSDSDIFTPYGWLEPWSGQPAHPPLNLSAKTELVAWAVSNWKPDSARVRYYQSLQAHLKVDVYGRSHKPLPKGTMMETLSRYKFYLAFENSLHPDYITEKLWRNALEAWAVPVVLGPSRSNYERFLPPDAFIHVDDFQSPKDLARYLQELDKDHARYLSYFRWRETLRPRSFSWALDFCKACWKLQQESRYQTVRSIAAWFT

SEQ ID NO: 152 - DNA, 2371 bp, Homo sapiens
tctcctcttgctctaagcagggtgtttgaccttctagtcgactgcgtcccctgtacccggcgccagctgtgttcctgaccccagaataactcagggctgcaccgggcctggcagcgctccgcacacatttcctgtcgcggcctaagggaaactgttggccgctgggcccgcggggggattcttggcagttggggggtccgtcgggagcgagggcggaggggaagggagggggaaccgggttggggaagccagctgtagagggcggtgaccgcgctccagacacagctctgcgtcctcgagcgggacagatccaagttgggagcagctctgcgtgcggggcctcagagaatgaggccggcgttcgccctgtgcctcctctggcaggcgctctggcccgggccgggcggcggcgaacaccccactgccgaccgtgctggctgctcggcctcgggggcctgctacagcctgcaccacgctaccatgaagcggcaggcggccgaggaggcctgcatcctgcgaggtggggcgctcagcaccgtgcgtgcgggcgccgagctgcgcgctgtgctcgcgctcctgcgggcaggcccagggcccggagggggctccaaagacctgctgttctgggtcgcactggagcgcaggcgttcccactgcaccctggagaacgagcctttgcggggtttctcctggctgtcctccgaccccggcggtctcgaaagcgacacgctgcagtgggtggaggagccccaacgctcctgcaccgcgcggagatgcgcggtactccaggccaccggtggggtcgagcccgcaggctggaaggagatgcgatgccacctgcgcgccaacggctacctgtgcaagtaccagtttgaggtcttgtgtcctgcgccgcgccccggggccgcctctaacttgagctatcgcgcgcccttccagctgcacagcgccgctctggacttcagtccacctgggaccgaggtgagtgcgctctgccggggacagctcccgatctcagttacttgcatcgcggacgaaatcggcgctcgctgggacaaactctcgggcgatgtgttgtgtccctgccccgggaggtacctccgtgctggcaaatgcgcagagctccctaactgcctagacgacttgggaggctttgcctgcgaatgtgctacgggcttcgagctggggaaggacggccgctcttgtgtgaccagtggggaaggacagccgacccttggggggaccggggtgcccaccaggcgcccgccggccactgcaaccagccccgtgccgcagagaacatggccaatcagggtcgacgagaagctgggagagacaccacttgtccctgaacaagacaattcagtaacatctattcctgagattcctcgatggggatcacagagcacgatgtctacccttcaaatgtcccttcaagccgagtcaaaggccactatcaccccatcagggagcgtgatttccaagtttaattctacgacttcctctgccactcctcaggctttcgactcctcctctgccgtggtcttcatatttgtgagcacagcagtagtagtgttggtgatcttgaccatgacagtactggggcttgtcaagctctgctttcacgaaagcccctcttcccagccaaggaaggagtctatgggcccgccgggcctggagagtgatcctgagcccgctgctttgggctccagttctgcacattgcacaaacaatggggtgaaagtcggggactgtgatctgcgggacagagcagagggtgccttgctggcggagtcccctcttggctctagtgatgcatagggaaacaggggacatgggcactcctgtgaacagtttttcacttttgatgaaacggggaaccaagaggaacttacttgtgtaactgacaatttctgcagaaatcccccttcctctaaattccctttactccactgaggagctaaatcagaactgcacactccttccctgatgatagaggaagtggaagtgcctttaggatggtgatactgggggaccgggtagtgctggggagagatattttcttatgtttattcggagaatttggagaagtgattgaacttttcaagacattggaaacaaatagaacacaatataatttacattaaaaaataatttctaccaaaatggaaaggaaatgttctatgttgttcaggctaggagtatattggttcgaaatcccagggaaaaaaataaaaataaaaaattaaaggattgttgataacccagactcaaatatcattgccttcctccaggagtaattaggaacagctgagggcatgctgggagtaagcagcaagagtgcattctgcttttagattgagggagaggt

SEQ ID NO: 153 - protein, 490 aa, Homo sapiens
MRPAFALCLLWQALWPGPGGGEHPTADRAGCSASGACYSLHHATMKRQAAEEACILRGGALSTVRAGAELRAVLALLRAGPGPGGGSKDLLFWVALERRRSHCTLENEPLRGFSWLSSDPGGLESDTLQWVEEPQRSCTARRCAVLQATGGVEPAGWKEMRCHLRANGYLCKYQFEVLCPAPRPGAASNLSYRAPFQLHSAALDFSPPGTEVSALCRGQLPISVTCIADEIGARWDKLSGDVLCPCPGRYLRAGKCAELPNCLDDLGGFACECATGFELGKDGRSCVTSGEGQPTLGGTGVPTRRPPATATSPVPQRTWPIRVDEKLGETPLVPEQDNSVTSIPEIPRWGSQSTMSTLQMSLQAESKATITPSGSVISKFNSTTSSATPQAFDSSSAVVFIFVSTAVVVLVILTMTVLGLVKLCFHESPSSQPRKESMGPPGLESDPEPAALGSSSAHCTNNGVKVGDCDLRDRAEGALLAESPLGSSDA

SEQ ID NO: 154 - DNA, 3973 bp, Homo sapiens
gggctgggggagggtatataagccgagtaggcgacggtgaggtcgacgccggccaagacagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactggtctaatgtttgtgagaagcttctaattagatcaattacttattttaggaaatttaagactagatactcgtgtgtggggtgaggggagggagtatttggtatgttgggataaggaaacacttctatttaatgcttccagggatttttttttttttttttaaccctcctgggcccaagtgatccttccacctcagtctcccagctaattgagaccacaggcttgttaccaccatgctcggcttttgcattaatctaagaaaaggggagagaagttaatccacatctttactcaggcaaggggcatttcacagtgcccaagagtggggttttcttgaacatacttggtttcctatttccccttatctttctaaaactgcctttctggtggctttttttaaaattattactaatgatgcttttatagctgcttggattctctgagaaatgatggggagtgagtgatcactggtattaactttatacacttggatttcatttgtaactttaggatgtaaaggtatattgtgaaccctagctgtgtcagaatctccatccctgaaatttctcattagtggtactggggtgggatcttggatggtgacattgaaactacactaaatcccctcactatgaatgggttgttaaaggcaatggtttgtgtcaaaactggtttaggattacttagattgtgttcctgaagaaaagagtccaggtaaatggtatgatcaataaaggacaggctggtgctaacataaaatccaatattgtaatcctagcactttgggaggccaaggcgggtggatcacaaggtcaagagatagagaccatctttgccaacatggtgaaactccatctctactgaaaatacaaaaattagctgggcgtggtagtgcaagctgaaggctgaggcaggagaatcactcgaacccgggaggcagaggttgcagtgagccgagatcacaccactgtactccagcccggcactccagcctggcgacaagagtgagactccacctcaaaaaaaaaaaaaagaatccaatactgcccaaggataggtattttatagatgggcaactggctgaaaggttaattctctagggctagtagaactggatcccaacaccaaactcttaattagacctaggcctcagctgcactgcccgaaaagcatttgggcagaccctgagcagaatactggtctcaggccaagcccaatacagccattaaagatgacctacagtgctgtgtaccctggggcaatagggttaaatggtagttagcaactagggctagtcttcccttacctcaaaggctctcactaccgtggaccacctagtctgtaactctttctgaggagctgttactgaatattaaaaagatagacttcaactatgaaa

SEQ ID NO: 155 - protein, 654 aa, Homo sapiens
MKLSLVAAMLLLLSAARAEEEDKKEDVGTVVGIDLGTTYSCVGVFKNGRVEIIANDQGNRITPSYVAFTPEGERLIGDAAKNQLTSNPENTVFDAKRLIGRTWNDPSVQQDIKFLPFKVVEKKTKPYIQVDIGGGQTKTFAPEEISAMVLTKMKETAEAYLGKKVTHAVVTVPAYFNDAQRQATKDAGTIAGLNVMRIINEPTAAAIAYGLDKREGEKNILVFDLGGGTFDVSLLTIDNGVFEVVATNGDTHLGGEDFDQRVMEHFIKLYKKKTGKDVRKDNRAVQKLRREVEKAKRALSSQHQARIEIESFYEGEDFSETLTRAKFEELNMDLFRSTMKPVQKVLEDSDLKKSDIDEIVLVGGSTRIPKIQQLVKEFFNGKEPSRGINPDEAVAYGAAVQAGVLSGDQDTGDLVLLDVCPLTLGIETVGGVMTKLIPRNTVVPTKKSQIFSTASDNQPTVTIKVYEGERPLTKDNHLLGTFDLTGIPPAPRGVPQIEVTFEIDVNGILRVTAEDKGTGNKNKITITNDQNRLTPEEIERMVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAEKDEL

SEQ ID NO: 156 - DNA, 926 bp, Homo sapiens
ccagagaggggcaggcttgtcccctgacaggttgaagcaagtagacgcccaggagccccgggagggggctgcagtttccttccttccttctcggcagcgctccgcgcccccatcgcccctcctgcgctagcggaggtgatcgccgcggcgatgccggaggagggttcgggctgctcggtgcggcgcaggccctatgggtgcgtcctgcgggctgctttggtcccattggtcgcgggcttggtgatctgcctcgtggtgtgcatccagcgcttcgcacaggctcagcagcagctgccgctcgagtcacttgggtgggacgtagctgagctgcagctgaatcacacaggacctcagcaggaccccaggctatactggcaggggggcccagcactgggccgctccttcctgcatggaccagagctggacaaggggcagctacgtatccatcgtgatggcatctacatggtacacatccaggtgacgctggccatctgctcctccacgacggcctccaggcaccaccccaccaccctggccgtgggaatctgctctcccgcctcccgtagcatcagcctgctgcgtctcagcttccaccaaggttgtaccattgtctcccagcgcctgacgcccctggcccgaggggacacactctgcaccaacctcactgggacacttttgccttcccgaaacactgatgagaccttctttggagtgcagtgggtgcgcccctgaccactgctgctgattagggttttttaaattttattttattttatttaagttcaagagaaaaagtgtacacacaggggccacccggggttggggtgggagtgtggtggggggtagtttgtggcaggacaagagaaggcattgagctttttctttcattttcctattaaaaaatacaaaaatcaaaacaaaaaaaa

SEQ ID NO: 157 - protein, 193 aa, Homo sapiens [sequence omitted]

SEQ ID NO: 158 - protein, 293 aa, Artificial sequence
  Synthetic construct
MGILPFLLIPMESNWTVHVFSRTLCHMLLWTAVLNLAAGTHDLPKAVVKLEPPWIQVLKEDTVTLTCEGTHNPGNSSTQWFHNGRSIRSQVQASYTFKATVNDSGEYRCQMEQTRLSDPVDLGVISDWLLLQTPQLVFLEGETITLRCHSWRNKLLNRISFFHNEKSVRYHHYSSNFSIPKANHSHSGDYYCKGSLGRTQHQSKTVTITVQGPKSSRSLPVLTIVAAVTGIAVAAIVIILVSLVYLKKKQVPDNPPDLEEAAKTEAENTITYSLLKHPEALDEETEHDYQNHI

SEQ ID NO: 159 - DNA, 2880 bp, Homo sapiens
tgctgctctccgcccgcgtccggctcgtggccccctacttcgggcaccatggacacctcccggctcggtgtgctcctgtccttgcctgtgctgctgcagctggcgaccgggggcagctctcccaggtctggtgtgttgctgaggggctgccccacacactgtcattgcgagcccgacggcaggatgttgctcagggtggactgctccgacctggggctctcggagctgccttccaacctcagcgtcttcacctcctacctagacctcagtatgaacaacatcagtcagctgctcccgaatcccctgcccagtctccgcttcctggaggagttacgtcttgcgggaaacgctctgacatacattcccaagggagcattcactggcctttacagtcttaaagttcttatgctgcagaataatcagctaagacacgtacccacagaagctctgcagaatttgcgaagccttcaatccctgcgtctggatgctaaccacatcagctatgtgcccccaagctgtttcagtggcctgcattccctgaggcacctgtggctggatgacaatgcgttaacagaaatccccgtccaggcttttagaagtttatcggcattgcaagccatgaccttggccctgaacaaaatacaccacataccagactatgcctttggaaacctctccagcttggtagttctacatctccataacaatagaatccactccctgggaaagaaatgctttgatgggctccacagcctagagactttagatttaaattacaataaccttgatgaattccccactgcaattaggacactctccaaccttaaagaactaggatttcatagcaacaatatcaggtcgatacctgagaaagcatttgtaggcaacccttctcttattacaatacatttctatgacaatcccatccaatttgttgggagatctgcttttcaacatttacctgaactaagaacactgactctgaatggtgcctcacaaataactgaatttcctgatttaactggaactgcaaacctggagagtctgactttaactggagcacagatctcatctcttcctcaaaccgtctgcaatcagttacctaatctccaagtgctagatctgtcttacaacctattagaagatttacccagtttttcagtctgccaaaagcttcagaaaattgacctaagacataatgaaatctacgaaattaaagttgacactttccagcagttgcttagcctccgatcgctgaatttggcttggaacaaaattgctattattcaccccaatgcattttccactttgccatccctaataaagctggacctatcgtccaacctcctgtcgtcttttcctataactgggttacatggtttaactcacttaaaattaacaggaaatcatgccttacagagcttgatatcatctgaaaactttccagaactcaaggttatagaaatgccttatgcttaccagtgctgtgcatttggagtgtgtgagaatgcctataagatttctaatcaatggaataaaggtgacaacagcagtatggacgaccttcataagaaagatgctggaatgtttcaggctcaagatgaacgtgaccttgaagatttcctgcttgactttgaggaagacctgaaagcccttcattcagtgcagtgttcaccttccccaggccccttcaaaccctgtgaacacctgcttgatggctggctgatcagaattggagtgtggaccatagcagttctggcacttacttgtaatgctttggtgacttcaacagttttcagatcccctctgtacatttcccccattaaactgttaattggggtcatcgcagcagtgaacatgctcacgggagtctccagtgccgtgctggctggtgtggatgcgttcacttttggcagctttgcacgacatggtgcctggtgggagaatggggttggttgccatgtcattggttttttgtccatttttgcttcagaatcatctgttttcctgcttactctggcagccctggagcgtgggttctctgtgaaatattctgcaaaatttgaaacgaaagctccattttctagcctgaaagtaatcattttgctctgtgccctgctggccttgaccatggccgcagttcccctgctgggtggcagcaagtatggcgcctcccctctctgcctgcctttgccttttggggagcccagcaccatgggctacatggtcgctctcatcttgctcaattccctttgcttcctcatgatgaccattgcctacaccaagctctactgcaatttggacaagggagacctggagaatatttgggactgctctatggtaaaacacattgccctgttgctcttcaccaactgcatcctaaactgccctgtggctttcttgtccttctcctctttaataaaccttacatttatcagtcctgaagtaattaagtttatccttctggtggtagtcccacttcctgcatgtctcaatccccttctctacatcttgttcaatcctcactttaaggaggatctggtgagcctgagaaagcaaacctacgtctggacaagatcaaaacacccaagcttgatgtcaattaactctgatgatgtcgaaaaacagtcctgtgactcaactcaagccttggtaacctttaccagctccagcatcacttatgacctgcctcccagttccgtgccatcaccagcttatccagtgactgagagctgccatctttcctctgtggcatttgtcccatgtctctaattaatatgtgaaggaaaatgttttcaaaggttgagaacctgaaaatgtgagattgagtatatcagagcagtaattaataagaagagctgaggtgaaactcggtttaaa

SEQ ID NO: 160 - protein, 907 aa, Homo sapiens
MDTSRLGVLLSLPVLLQLATGGSSPRSGVLLRGCPTHCHCEPDGRMLLRVDCSDLGLSELPSNLSVFTSYLDLSMNNISQLLPNPLPSLRFLEELRLAGNALTYIPKGAFTGLYSLKVLMLQNNQLRHVPTEALQNLRSLQSLRLDANHISYVPPSCFSGLHSLRHLWLDDNALTEIPVQAFRSLSALQAMTLALNKIHHIPDYAFGNLSSLVVLHLHNNRIHSLGKKCFDGLHSLETLDLNYNNLDEFPTAIRTLSNLKELGFHSNNIRSIPEKAFVGNPSLITIHFYDNPIQFVGRSAFQHLPELRTLTLNGASQITEFPDLTGTANLESLTLTGAQISSLPQTVCNQLPNLQVLDLSYNLLEDLPSFSVCQKLQKIDLRHNEIYEIKVDTFQQLLSLRSLNLAWNKIAIIHPNAFSTLPSLIKLDLSSNLLSSFPITGLHGLTHLKLTGNHALQSLISSENFPELKVIEMPYAYQCCAFGVCENAYKISNQWNKGDNSSMDDLHKKDAGMFQAQDERDLEDFLLDFEEDLKALHSVQCSPSPGPFKPCEHLLDGWLIRIGVWTIAVLALTCNALVTSTVFRSPLYISPIKLLIGVIAAVNMLTGVSSAVLAGVDAFTFGSFARHGAWWENGVGCHVIGFLSIFASESSVFLLTLAALERGFSVKYSAKFETKAPFSSLKVIILLCALLALTMAAVPLLGGSKYGASPLCLPLPFGEPSTMGYMVALILLNSLCFLMMTIAYTKLYCNLDKGDLENIWDCSMVKHIALLLFTNCILNCPVAFLSFSSLINLTFISPEVIKFILLVVVPLPACLNPLLYILFNPHFKEDLVSLRKQTYVWTRSKHPSLMSINSDDVEKQSCDSTQALVTFTSSSITYDLPPSSVPSPAYPVTESCHLSSVAFVPCL

SEQ ID NO: 161 - DNA, 3977 bp, Homo sapiens
ggatggtgccttgagtgaatgacccccttggagaacattcttccgcatccctcgcctcaagccagcctcagacagaaaactgaagattcagcagatccagtgcttcctgctcctcttctgcccaggaacacgcttgccttccccaaggcttccagaagctctgaggcaggaggcaccaagttctacctcatgtttggaggatcttgctagctatggccctcgtactcggctccctgttgctgctggggctgtgcgggaactccttttcaggagggcagccttcatccacagatgctcctaaggcttggaattatgaattgcctgcaacaaattatgagacccaagactcccataaagctggacccattggcattctctttgaactagtgcatatctttctctatgtggtacagccgcgtgatttcccagaagatactttgagaaaattcttacagaaggcatatgaatccaaaattgattatgacaagccagaaactgtaatcttaggtctaaagattgtctactatgaagcagggattattctatgctgtgtcctggggctgctgtttattattctgatgcctctggtggggtatttcttttgtatgtgtcgttgctgtaacaaatgtggtggagaaatgcaccagcgacagaaggaaaatgggcccttcctgaggaaatgctttgcaatctccctgttggtgatttgtataataataagcattggcatcttctatggttttgtggcaaatcaccaggtaagaacccggatcaaaaggagtcggaaactggcagatagcaatttcaaggacttgcgaactctcttgaatgaaactccagagcaaatcaaatatatattggcccagtacaacactaccaaggacaaggcgttcacagatctgaacagtatcaattcagtgctaggaggcggaattcttgaccgactgagacccaacatcatccctgttcttgatgagattaagtccatggcaacagcgatcaaggagaccaaagaggcgttggagaacatgaacagcaccttgaagagcttgcaccaacaaagtacacagcttagcagcagtctgaccagcgtgaaaactagcctgcggtcatctctcaatgaccctctgtgcttggtgcatccatcaagtgaaacctgcaacagcatcagattgtctctaagccagctgaatagcaaccctgaactgaggcagcttccacccgtggatgcagaacttgacaacgttaataacgttcttaggacagatttggatggcctggtccaacagggctatcaatcccttaatgatatacctgacagagtacaacgccaaaccacgactgtcgtagcaggtatcaaaagggtcttgaattccattggttcagatatcgacaatgtaactcagcgtcttcctattcaggatatactctcagcattctctgtttatgttaataacactgaaagttacatccacagaaatttacctacattggaagagtatgattcatactggtggctgggtggcctggtcatctgctctctgctgaccctcatcgtgattttttactacctgggcttactgtgtggcgtgtgcggctatgacaggcatgccaccccgaccacccgaggctgtgtctccaacaccggaggcgtcttcctcatggttggagttggattaagtttcctcttttgctggatattgatgatcattgtggttcttacctttgtctttggtgcaaatgtggaaaaactgatctgtgaaccttacacgagcaaggaattattccgggttttggatacaccctacttactaaatgaagactgggaatactatctctctgggaagctatttaataaatcaaaaatgaagctcacttttgaacaagtttacagtgactgcaaaaaaaatagaggcacttacggcactcttcacctgcagaacagcttcaatatcagtgaacatctcaacattaatgagcatactggaagcataagcagtgaattggaaagtctgaaggtaaatcttaatatctttctgttgggtgcagcaggaagaaaaaaccttcaggattttgctgcttgtggaatagacagaatgaattatgacagctacttggctcagactggtaaatcccccgcaggagtgaatcttttatcatttgcatatgatctagaagcaaaagcaaacagtttgcccccaggaaatttgaggaactccctgaaaagagatgcacaaactattaaaacaattcaccagcaacgagtccttcctatagaacaatcactgagcactctataccaaagcgtcaagatacttcaacgcacagggaatggattgttggagagagtaactaggattctagcttctctggattttgctcagaacttcatcacaaacaatacttcctctgttattattgaggaaactaagaagtatgggagaacaataataggatattttgaacattatctgcagtggatcgagttctctatcagtgagaaagtggcatcgtgcaaacctgtggccaccgctctagatactgctgttgatgtctttctgtgtagctacattatcgaccccttgaatttgttttggtttggcataggaaaagctactgtatttttacttccggctctaatttttgcggtaaaactggctaagtactatcgtcgaatggattcggaggacgtgtacgatgatgttgaaactatacccatgaaaaatatggaaaatggtaataatggttatcataaagatcatgtatatggtattcacaatcctgttatgacaagcccatcacaacattgatagctgatgttgaaactgcttgagcatcaggatactcaaagtggaaaggatcacagatttttggtagtttctgggtctacaaggactttccaaatccaggagcaacgccagtggcaacgtagtgactcaggcgggcaccaaggcaacggcaccattggtctctgggtagtgctttaagaatgaacacaatcacgttatagtccatggtccatcactattcaaggatgactccctcccttcctgtctatttttgttttttacttttttacactgagtttctatttagacactacaacatatggggtgtttgttcccattggatgcatttctatcaaaactctatcaaatgtgatggctagattctaacatattgccatgtgtggagtgtgctgaacacacaccagtttacaggaaagatgcattttgtgtacagtaaacggtgtatataccttttgttaccacagagttttttaaacaaatgagtattataggactttcttctaaatgagctaaataagtcaccattgacttcttggtgctgttgaaaataatccattttcactaaaagtgtgtgaaacctacagcatattcttcacgcagagattttcatctattatactttatcaaagattggccatgttccacttggaaatggcatgcaaaagcaatcatagagaaacctgcgtaactccatctgacaaattcaaaagagagagagagatcttgagagagaaatgctgttcgttcaaaagtggagttgttttaacagatgccaattacggtgtacagtttaacagagttttctgttgcattaggataaacattaattggagtgcagctaacatgagtatcatcagactagtatcaagtgttctaaaatgaaatatgagaagatcctgtcacaattcttagatctggtgtccagcatggatgaaacctttgagtttggtccctaaatttgcatgaaagcacaaggtaaatattcatttgcttcaggagtttcatgttggatctgtcattatcaaaagtgatcagcaatgaagaactggtcggacaaaatttaacgttgatgtaatgaaattccagatgtaggcattccccccaggtcttttcatgtgcagattgcagttctgattcatttgaataaaaaggaacttggaaaacatg

SEQ ID NO: 162 - protein, 865 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKPETVILGLKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNMENGNNGYHKDHVYGIHNPVMTSPSQH

SEQ ID NO: 163 - DNA, 3858 bp, Homo sapiens
ctactttattctgataaaacaggtctatgcagctaccaggacaatggaatctacgttgactttagcaacggaacaacctgttaagaagaacactcttaagaaatataaaatagcttgcattgttcttcttgctttgctggtgatcatgtcacttggattaggcctggggcttggactcaggaaactggaaaagcaaggcagctgcaggaagaagtgctttgatgcatcatttagaggactggagaactgccggtgtgatgtggcatgtaaagaccgaggtgattgctgctgggattttgaagacacctgtgtggaatcaactcgaatatggatgtgcaataaatttcgttgtggagagaccagattagaggccagcctttgctcttgttcagatgactgtttgcagaagaaagattgctgtgctgactataagagtgtttgccaaggagaaacctcatggctggaagaaaactgtgacacagcccagcagtctcagtgcccagaagggtttgacctgccaccagttatcttgttttctatggatggatttagagctgaatatttatacacatgggatactttaatgccaaatatcaataaactgaaaacatgtggaattcattcaaaatacatgagagctatgtatcctaccaaaaccttcccaaatcattacaccattgtcacgggcttgtatccagagtcacatggcatcattgacaataatatgtatgatgtaaatctcaacaagaatttttcactttcttcaaaggaacaaaataatccagcctggtggcatgggcaaccaatgtggctgacagcaatgtatcaaggtttaaaagccgctacctacttttggcccggatcagaagtggctataaatggctcctttccttccatatacatgccttacaacggaagtgtcccatttgaagagaggatttctacactgttaaaatggctggacctgcccaaagctgaaagacccaggttttataccatgtattttgaagaacctgattcctctggacatgcaggtggaccagtcagtgccagagtaattaaagccttacaggtagtagatcatgcttttgggatgttgatggaaggcctgaagcagcggaatttgcacaactgtgtcaatatcatccttctggctgaccatggaatggaccagacttattgtaacaagatggaatacatgactgattattttcccagaataaacttcttctacatgtacgaagggcctgccccccgcatccgagctcataatatacctcatgacttttttagttttaattctgaggaaattgttagaaacctcagttgccgaaaacctgatcagcatttcaagccctatttgactcctgatttgccaaagcgactgcactatgccaagaacgtcagaatcgacaaagttcatctctttgtggatcaacagtggctggctgttaggagtaaatcaaatacaaattgtggaggaggcaaccatggttataacaatgagtttaggagcatggaggctatctttctggcacatggacccagttttaaagagaagactgaagttgaaccatttgaaaatattgaagtctataacctaatgtgtgatcttctacgcattcaaccagcaccaaacaatggaacccatggtagtttaaaccatcttctgaaggtgcctttttatgagccatcccatgcagaggaggtgtcaaagttttctgtttgtggctttgctaatccattgcccacagagtctcttgactgtttctgccctcacctacaaaatagtactcagctggaacaagtgaatcagatgctaaatctcacccaagaagaaataacagcaacagtgaaagtaaatttgccatttgggaggcctagggtactgcagaagaacgtggaccactgtctcctttaccacagggaatatgtcagtggatttggaaaagctatgaggatgcccatgtggagttcatacacagtcccccagttgggagacacatcgcctctgcctcccactgtcccagactgtctgcgggctgatgtcagggttcctccttctgagagccaaaaatgttccttctatttagcagacaagaatatcacccacggcttcctctatcctcctgccagcaatagaacatcagatagccaatatgatgctttaattactagcaatttggtacctatgtatgaagaattcagaaaaatgtgggactacttccacagtgttcttcttataaaacatgccacagaaagaaatggagtaaatgtggttagtggaccaatatttgattataattatgatggccattttgatgctccagatgaaattaccaaacatttagccaacactgatgttcccatcccaacacactactttgtggtgctgaccagttgtaaaaacaagagccacacaccggaaaactgccctgggtggctggatgtcctaccctttatcatccctcaccgacctaccaacgtggagagctgtcctgaaggtaaaccagaagctctttgggttgaagaaagatttacagctcacattgcccgggtccgtgatgtagaacttctcactgggcttgacttctatcaggataaagtgcagcctgtctctgaaattttgcaactaaagacatatttaccaacatttgaaaccactatttaacttaataatgtctacttaatatataatttactgtataaagtaattttggcaaaatataagtgattttttctggagaattgtaaaataaagttttctatttttccttaaaaaaaaaaccggaattccgggcttgggaggctgaggcaggagactcgcttgaacccgggaggcagaggttgcagtgagccaagattgcgccattgcactccagagcctgggtgacagagcaagactacatctcaaaaaataaataaataaaataaaagtaacaataaaaataaaaagaacagcagagagaatgagcaaggagaaatgtcacaaactattgcaaaatactgttacactgggttggctctccaagaagatactggaatctcttcagccatttgcttttcagaagtagaaaccagcaaaccacctctaagcggagaacatacgattctttattaagtagctctggggaaggaaagaataaaagttgatagctccctgattgggaaaaaatgcacaattaataaagaatgaagatgaaagaaagcatgcttatgttgtaacacaaaaaaaattcacaaacgttggtggaaggaaaacagtatagaaaacattactttaactaaaagctggaaaaattttcagttgggatgcgactgacaaaaagaacgggatttccaggcataaagttggcgtgagctacagagggcaccatgtggctcagtggaagacccttcaagattcaaagttccatttgacagagcaaaggcacttcgcaaggagaagggtttaaattatgggtccaaaagccaagtggtaaagcgagcaatttgcagcataactgcttctcctagacagggctgagtgggcaaaatacgacagtacacacagtgactattagccactgccagaaacaggctgaacagccctgggagacaagggaaggcaggtggtgggagttgttcatggagagaaaggagagttttagaaccagcacatccactggagatgctgggccaccagacccctcccagtcaataaagtctggtgcctcatttgatctcagcctcatcatgaccctggagagaccctgataccatctgccagtccccgacagcttaggcactccttgccatcaacctgaccccccgagtggttctccaggctccctgccccacccattcaggccggaattc

SEQ ID NO: 164 - protein, 875 aa, Homo sapiens
MESTLTLATEQPVKKNTLKKYKIACIVLLALLVIMSLGLGLGLGLRKLEKQGSCRKKCFDASFRGLENCRCDVACKDRGDCCWDFEDTCVESTRIWMCNKFRCGETRLEASLCSCSDDCLQKKDCCADYKSVCQGETSWLEENCDTAQQSQCPEGFDLPPVILFSMDGFRAEYLYTWDTLMPNINKLKTCGIHSKYMRAMYPTKTFPNHYTIVTGLYPESHGIIDNNMYDVNLNKNFSLSSKEQNNPAWWHGQPMWLTAMYQGLKAATYFWPGSEVAINGSFPSIYMPYNGSVPFEERISTLLKWLDLPKAERPRFYTMYFEEPDSSGHAGGPVSARVIKALQVVDHAFGMLMEGLKQRNLHNCVNIILLADHGMDQTYCNKMEYMTDYFPRINFFYMYEGPAPRIRAHNIPHDFFSFNSEEIVRNLSCRKPDQHFKPYLTPDLPKRLHYAKNVRIDKVHLFVDQQWLAVRSKSNTNCGGGNHGYNNEFRSMEAIFLAHGPSFKEKTEVEPFENIEVYNLMCDLLRIQPAPNNGTHGSLNHLLKVPFYEPSHAEEVSKFSVCGFANPLPTESLDCFCPHLQNSTQLEQVNQMLNLTQEEITATVKVNLPFGRPRVLQKNVDHCLLYHREYVSGFGKAMRMPMWSSYTVPQLGDTSPLPPTVPDCLRADVRVPPSESQKCSFYLADKNITHGFLYPPASNRTSDSQYDALITSNLVPMYEEFRKMWDYFHSVLLIKHATERNGVNVVSGPIFDYNYDGHFDAPDEITKHLANTDVPIPTHYFVVLTSCKNKSHTPENCPGWLDVLPFIIPHRPTNVESCPEGKPEALWVEERFTAHIARVRDVELLTGLDFYQDKVQPVSEILQLKTYLPTFETTI

SEQ ID NO: 165 - DNA, 585 bp, Homo sapiens
caacgcagagttgggagcaactccagagcctccttcaagatgctgctggtcctgctctcagtggtccttctggctctgagctcagctcagagcacagataatgatgtgaactatgaagactttactttcaccataccagatgtagaggactcaagtcagagaccagatcagggaccccagagacctcctcctgaaggactcctacctagaccccctggtgatagtggtaaccaagatgatggtcctcagcagagaccaccaaaaccaggaggccatcaccgccatcctcccccacctccttttcaaaatcagcaacgaccaccccgacgaggacaccgtcaactctctctaccccgatttccttctgtcagcctgcaggaagcatcatcattcttccagagggacagaccagcaagacatccccaggagcaaccactctggtaatctagaattcagtggcagaaaataaataagaagataacttccttcagaaagccatgacattgaaataatgtggtcataactctttcttcagtataccaataaaatattaatagcatgcaaaaaaaaaaaaaaaaaaaaaaa

SEQ ID NO: 166 - protein, 134 aa, Homo sapiens
MLLVLLSVVLLALSSAQSTDNDVNYEDFTFTIPDVEDSSQRPDQGPQRPPPEGLLPRPPGDSGNQDDGPQQRPPKPGGHHRHPPPPPFQNQQRPPRRGHRQLSLPRFPSVSLQEASSFFQRDRPARHPQEQPLW

SEQ ID NO: 167 - DNA, 3850 bp, Homo sapiens
gaccagagagaagcgtggggaagagtgggctgagggactccactagaggctgtccatctggattccctgcctccctaggagcccaacagagcaaagcaagtgggcacaaggagtatggttctaacgtgattggggtcatgaagacgttgctgttggacttggctttgtggtcactgctcttccagcccgggtggctgtcctttagttcccaggtgagtcagaactgccacaatggcagctatgaaatcagcgtcctgatgatgggcaactcagcctttgcagagcccctgaaaaacttggaagatgcggtgaatgaggggctggaaatagtgagaggacgtctgcaaaatgctggcctaaatgtgactgtgaacgctactttcatgtattcggatggtctgattcataactcaggcgactgccggagtagcacctgtgaaggcctcgacctactcaggaaaatttcaaatgcacaacggatgggctgtgtcctcatagggccctcatgtacatactccaccttccagatgtaccttgacacagaattgagctaccccatgatctcagctggaagttttggattgtcatgtgactataaagaaaccttaaccaggctgatgtctccagctagaaagttgatgtacttcttggttaacttttggaaaaccaacgatctgcccttcaaaacttattcctggagcacttcgtatgtttacaagaatggtacagaaactgaggactgtttctggtaccttaatgctctggaggctagcgtttcctatttctcccacgaactcggctttaaggtggtgttaagacaagataaggagtttcaggatatcttaatggaccacaacaggaaaagcaatgtgattattatgtgtggtggtccagagttcctctacaagctgaagggtgaccgagcagtggctgaagacattgtcattattctagtggatcttttcaatgaccagtactttgaggacaatgtcacagcccctgactatatgaaaaatgtccttgttctgacgctgtctcctgggaattcccttctaaatagctctttctccaggaatctatcaccaacaaaacgagactttgctcttgcctatttgaatggaatcctgctctttggacatatgctgaagatatttcttgaaaatggagaaaatattaccacccccaaatttgctcatgctttcaggaatctcacttttgaagggtatgacggtccagtgaccttggatgactggggggatgttgacagtaccatggtgcttctgtatacctctgtggacaccaagaaatacaaggttcttttgacctatgatacccacgtaaataagacctatcctgtggatatgagccccacattcacttggaagaactctaaacttcctaatgatattacaggccggggccctcagatcctgatgattgcagtcttcaccctcactggagctgtggtgctgctcctgctcgtcgctctcctgatgctcagaaaatatagaaaagattatgaacttcgtcagaaaaaatggtcccacattcctcctgaaaatatctttcctctggagaccaatgagaccaatcatgttagcctcaagatcgatgatgacaaaagacgagatacaatccagagactacgacagtgcaaatacgacaaaaagcgagtgattctcaaagatctcaagcacaatgatggtaatttcactgaaaaacagaagatagaattgaacaagttgcttcagattgactattacaacctgaccaagttctacggcacagtgaaacttgataccatgatcttcggggtgatagaatactgtgagagaggatccctccgggaagttttaaatgacacaatttcctaccctgatggcacattcatggattgggagtttaagatctctgtcttgtatgacattgctaagggaatgtcatatctgcactccagtaagacagaagtccatggtcgtctgaaatctaccaactgcgtagtggacagtagaatggtggtgaagatcactgattttggctgcaattccattttacctccaaaaaaggacctgtggacagctccagagcacctccgccaagccaacatctctcagaaaggagatgtgtacagctatgggatcatcgcacaggagatcatcctgcggaaagaaaccttctacactttgagctgtcgggaccggaatgagaagattttcagagtggaaaattccaatggaatgaaacccttccgcccagatttattcttggaaacagcagaggaaaaagagctagaagtgtacctacttgtaaaaaactgttgggaggaagatccagaaaagagaccagatttcaaaaaaattgagactacacttgccaagatatttggactttttcatgaccaaaaaaatgaaagctatatggataccttgatccgacgtctacagctatattctcgaaacctggaacatctggtagaggaaaggacacagctgtacaaggcagagagggacagggctgacagacttaactttatgttgcttccaaggctagtggtaaagtctctgaaggagaaaggctttgtggagccggaactatatgaggaagttacaatctacttcagtgacattgtaggtttcactactatctgcaaatacagcacccccatggaagtggtggacatgcttaatgacatctataagagttttgaccacattgttgatcatcatgatgtctacaaggtggaaaccatcggtgatgcgtacatggtggctagtggtttgcctaagagaaatggcaatcggcatgcaatagacattgccaagatggccttggaaatcctcagcttcatggggacctttgagctggagcatcttcctggcctcccaatatggattcgcattggagttcactctggtccctgtgctgctggagttgtgggaatcaagatgcctcgttattgtctatttggagatacggtcaacacagcctctaggatggaatccactggcctccctttgagaattcacgtgagtggctccaccatagccatcctgaagagaactgagtgccagttcctttatgaagtgagaggagaaacatacttaaagggaagaggaaatgagactacctactggctgactgggatgaaggaccagaaattcaacctgccaacccctcctactgtggagaatcaacagcgtttgcaagcagaattttcagacatgattgccaactctttacagaaaagacaggcagcagggataagaagccaaaaacccagacgggtagccagctataaaaaaggcactctggaatacttgcagctgaataccacagacaaggagagcacctatttttaaacctaaatgaggtataaggactcacacaaattaaaatacagctgcactgaggcagcgacctcaagtgtcctgaaagcttacattttcctgagacctcaatgaagcagaaatgtacttaggcttggctgccctgtctggaacatggactttcttgcatgaatcagatgtgtgttctcagtgaaataactaccttccactctggaaccttattccagcagttgttccagggagcttctacctggaaaagaaaagaaatgaatagactatctagaacttgagaagattttattcttatttcatttattttttgtttgtttatttttatcgtttttgtttactggctttccttctgtattcataagattttttaaattgtcataattatattttaaatacccatcttcattaaagtatatttaactcataatttttgcagaaaatatgctatatattaggcaagaataaaagctaaaggtttcccaaaaaaaaaa

SEQ ID NO: 168 - protein, 1073 aa, Homo sapiens
MKTLLLDLALWSLLFQPGWLSFSSQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQILMIAVFTLTGAVVLLLLVALLMLRKYRKDYELRQKKWSHIPPENIFPLETNETNHVSLKIDDDKRRDTIQRLRQCKYDKKRVILKDLKHNDGNFTEKQKIELNKLLQIDYYNLTKFYGTVKLDTMIFGVIEYCERGSLREVLNDTISYPDGTFMDWEFKISVLYDIAKGMSYLHSSKTEVHGRLKSTNCVVDSRMVVKITDFGCNSILPPKKDLWTAPEHLRQANISQKGDVYSYGIIAQEIILRKETFYTLSCRDRNEKIFRVENSNGMKPFRPDLFLETAEEKELEVYLLVKNCWEEDPEKRPDFKKIETTLAKIFGLFHDQKNESYMDTLIRRLQLYSRNLEHLVEERTQLYKAERDRADRLNFMLLPRLVVKSLKEKGFVEPELYEEVTIYFSDIVGFTTICKYSTPMEVVDMLNDIYKSFDHIVDHHDVYKVETIGDAYMVASGLPKRNGNRHAIDIAKMALEILSFMGTFELEHLPGLPIWIRIGVHSGPCAAGVVGIKMPRYCLFGDTVNTASRMESTGLPLRIHVSGSTIAILKRTECQFLYEVRGETYLKGRGNETTYWLTGMKDQKFNLPTPPTVENQQRLQAEFSDMIANSLQKRQAAGIRSQKPRRVASYKKGTLEYLQLNTTDKESTYF

SEQ ID NO: 169 - DNA, 2744 bp, Homo sapiens
ctcgtgccgaattcggcacgagaccgcgtgttcgcgcctggtagagatttctcgaagacaccagtgggcccgtgtggaaccaaacctgcgcgcgtggccgggccgtgggacaacgaggccgcggagacgaaggcgcaatggcgaggaagttatctgtaatcttgatcctgacctttgccctctctgtcacaaatccccttcatgaactaaaagcagctgctttcccccagaccactgagaaaattagtccgaattgggaatctggcattaatgttgacttggcaatttccacacggcaatatcatctacaacagcttttctaccgctatggagaaaataattctttgtcagttgaagggttcagaaaattacttcaaaatataggcatagataagattaaaagaatccatatacaccatgaccacgaccatcactcagaccacgagcatcactcagaccatgagcgtcactcagaccatgagcatcactcagaccacgagcatcactctgaccataatcatgctgcttctggtaaaaataagcgaaaagctctttgcccagaccatgactcagatagttcaggtaaagatcctagaaacagccaggggaaaggagctcaccgaccagaacatgccagtggtagaaggaatgtcaaggacagtgttagtgctagtgaagtgacctcaactgtgtacaacactgtctctgaaggaactcactttctagagacaatagagactccaagacctggaaaactcttccccaaagatgtaagcagctccactccacccagtgtcacatcaaagagccgggtgagccggctggctggtaggaaaacaaatgaatctgtgagtgagccccgaaaaggctttatgtattccagaaacacaaatgaaaatcctcaggagtgtttcaatgcatcaaagctactgacatctcatggcatgggcatccaggttccgctgaatgcaacagagttcaactatctctgtccagccatcatcaaccaaattgatgctagatcttgtctgattcatacaagtgaaaagaaggctgaaatccctccaaagacctattcattacaaatagcctgggttggtggttttatagccatttccatcatcagtttcctgtctctgctgggggttatcttagtgcctctcatgaatcgggtgtttttcaaatttctcctgagtttccttgtggcactggccgttgggactttgagtggtgatgcttttttacaccttcttccacattctcatgcaagtcaccaccatagtcatagccatgaagaaccagcaatggaaatgaaaagaggaccacttttcagtcatctgtcttctcaaaacatagaagaaagtgcctattttgattccacgtggaagggtctaacagctctaggaggcctgtatttcatgtttcttgttgaacatgtcctcacattgatcaaacaatttaaagataagaagaaaaagaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccactttggcctggatggtgataatgggtgatggcctgcacaatttcagcgatggcctagcaattggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtacctgaaatgctgcacaatgatgctagtgaccatggatgtagccgctgggggtatttctttttacagaatgctgggatgcttttgggttttggaattatgttacttatttccatatttgaacataaaatcgtgtttcgtataaatttctagttaaggtttaaatgctagagtagcttaaaaagttgtcatagtttcagtaggtcatagggagatgagtttgtatgctgtactatgcagcgtttaaagttagtgggttttgtgatttttgtattgaatattgctgtctgttacaaagtcagttaaaggtacgttttaatatttaagttattctatcttggagataaaatctgtatgtgcaattcaccggtattaccagtttattatgtaaacaagagatttggcatgacatgttctgtatgtttcagggaaaaatgtctttaatgctttttcaagaactaacacagttattcctatactggattttaggtctctgaagaactgctggtg

SEQ ID NO: 170 - protein, 749 aa, Homo sapiens
MARKLSVILILTFALSVTNPLHELKAAAFPQTTEKISPNWESGINVDLAISTRQYHLQQLFYRYGENNSLSVEGFRKLLQNIGIDKIKRIHIHHDHDHHSDHEHHSDHERHSDHEHHSDHEHHSDHNHAASGKNKRKALCPDHDSDSSGKDPRNSQGKGAHRPEHASGRRNVKDSVSASEVTSTVYNTVSEGTHFLETIETPRPGKLFPKDVSSSTPPSVTSKSRVSRLAGRKTNESVSEPRKGFMYSRNTNENPQECFNASKLLTSHGMGIQVPLNATEFNYLCPAIINQIDARSCLIHTSEKKAEIPPKTYSLQIAWVGGFIAISIISFLSLLGVILVPLMNRVFFKFLLSFLVALAVGTLSGDAFLHLLPHSHASHHHSHSHEEPAMEMKRGPLFSHLSSQNIEESAYFDSTWKGLTALGGLYFMFLVEHVLTLIKQFKDKKKKNQKKPENDDDVEIKKQLSKYESQLSTNEEKVDTDDRTEGYLRADSQEPSHFDSQQPAVLEEEEVMIAHAHPQEVYNEYVPRGCKNKCHSHFHDTLGQSDDLIHHHHDYHHILHHHHHQNHHPHSHSQRYSREELKDAGVATLAWMVIMGDGLHNFSDGLAIGAAFTEGLSSGLSTSVAVFCHELPHELGDFAVLLKAGMTVKQAVLYNALSAMLAYLGMATGIFIGHYAENVSMWIFALTAGLFMYVALVDMVPEMLHNDASDHGCSRWGYFFLQNAGMLLGFGIMLLISIFEHKIVFRINF

SEQ ID NO: 171 - DNA, 5551 bp, Homo sapiens
  misc_feature (1769)..(1769): n is a, c, g, or t
ttttcatggaaatatcttcaaatttcattagtggtcctattatagaagacacacagcaggcaagtgtcagagctagaaatgaccctaaatttctgggtccctattcagcagccataagcaattgccagctgcaggaaggtggaggcagaagaagtaaaaagggaacaagaggtgaggtttacgttctgcctaagtggaacagagtagaactttgcacaaactccttaatcttgcctagaggcagaatgtgggatgtactatatgggaggcaggcaaatctgggcctggttcccacctccatcactcatttgaacaagttatgtaatttatttttgcgtcaattttcttgtctgtaaaactggagtgagaggacctaacttgagtaccgaagtgaagagtcaatgagataatatctgtgatcagcacagtgcttggcaagtggaagacactcagtcaagctaacttaaagccccagttttttcatttgtacaacagaacaacaacaataatagcaacaagcaataatactaacaatatttatcttgcctctgagttgtcttgaaaatcagatgagtatatatattatgtttctaaattctaaagtgtatctcactctcctaacaaagcagttggtcttcagatcaggaccagagttaataccatgccagagcattattacaggttttttccaatgagtaattaattttatttttaaacttatcatacagtaaaattgactcttttggtttacaaagttctatgagttatagcacgttgtataggtttatgtaaccaccaccacaatccggatacagaacatgactacagctttagagattctttttcaaagtgttttacattcatgttgcaaaacacttttaaaaataagaaaagagatgtagataaacgtgctgaagatgcaaattaatgaaaccagcttttgtgcacaaatctctgcagtttccagtgttttcagcttttgtctgagccatttttgctgtcggctttgcagactatctctttctataaaagtaatcaggcgtccgttggagagttgggtctttcttcacattaaaggcacatgtcccaggcacaagcctcaggatccttatttgatcttttttaatacgaccaggtcttaaatttccgaaccatgttttccctaattgccattttctctctaaaatgaagaagcctggaagaaccttcttatcccttcggggaaattatttaattgggacaaaggggatgtggagttacagagagcaacgatagggctttcaggaacccaaaacctgtctggtataataacagatccttccggtaaccaaccattcaatttgtccctctcccccaaccccatcctctccatcaccatctgccagatggccccctgggaccaatcgactttgaaaccaaacttctctcccaggtcagctcctgcaatccccactcctcgtcccttggagctttctccacagaagtgacttgacacaccgcgctacatctggggaggggggcgggtccgctttccgggagactcaagtctttgctatttgccttttgtttctgggatgcctttggctgcctttctcttccatctgcttttaattttggtaagagaaaagctaatgaatcaggaatgaatctcctctccactaatctttwtgttttctttctctctctctctctcttagagttggcgcgctctcttcacgagttccatcactacccaagaagtgagggggcgggggggacaggcgggaagncattaattacacctaaatctgaagtttgcggcctcaagtaccactttgatggggagagcttctgaagcttccatacaacctgccgtgcctttgctgctgccgcagtagattttcagctcatttctttctgctgctgcttcgcgctgctctgtcatgcctaaatctatctcgtcactgccaaaggtgcctgaatcagggtgaattccacgagattcaccagcggttttgctccagtccaaggtaaatacagtatgcaaaatgaggaaccacccaaggatgtcggggaggggggagagaaagggattccctcaccttttccggcacattcctcgttaatttccaccaggaggaggcgcgcagcccagctcccctagtctctcttcttaaatccccctacctacggctgccgaggttggccgcgcgtcgggagtctccccgacagtcctggccctcccccgccccccgggttggtttttcccagctgcggaggttgggaggttgggccaggggctggggtgcgaagagagtcggcgcccgcaacgcggagccgggaagtcgtcgctactctggtggaactcagagttggttctggaggcggcggacgcggaggtgagcagtgggagcccgcggcctgggagagacccgggaggcgtcgttggggcccctccccatcctcgggtggagagtagggttggttcgggttgccactgtaccccgagtcccactgctgctttgttcccagactctcccctcctctttggagatgacttgaacccctttgagatccgaggggctggcggggcgcgggctggggggcgacagttgtagctccacttcctgctaatgcgagaaggtacaaaaagagatcaaaaagtcctgtaacctgaaacttccctcgcatcctaaccgggaccgggtggagaggtctgggcgggggcggagacacccggaggccgaccttccgccgaggcggtgcaggaaggaacgggagagggagaagtttggtagggaaggaattggggattaagcggtaagttagacgcgggagacgatctcctcgggaaaggcggagggcgggaggccggtcgggtttatttagtgtgggccagggaagaaggaagactttgcggtctgggtgtcggatgcgcgtccccctccggagtaaaagtgaccggaggggttggggaggcgaggccggggcgggcttttggaaggaggtctctgggacagactggagacgactagactcgaaaaggccggtttttgcactccggaagccgcggcagccaccgctgttcacgcctctctcctgcttgtcccaggtccctcagaggatccagcgaggggtgccaacaagaggcgaagaggtggcaccagggcggcggcaggaagaggagcgggagcaggagcgcggagcggagcgtcccgacccgccgtgcgtactttctggagggaaggggcgggggaatcggcccctgagggaagcgcccggtggcgagggggttagccaagttccggctgcggcgccactccctcggttccacgagaggaaagttttttttttccagacgcttccgccggctcgcgccctccgggcccagcctcccgagccttcggagcgggcgccgtcccagcccagctccggggaaacgcgagccgcgatgcctggggggtgctcccggggccccgccgccggggacgggcgtctgcggctggcgcgactagcgctggtactcctgggctgggtctcctcgtcttctcccacctcctcggcatcctccttctcctcctcggcgccgttcctggcttccgccgtgtccgcccagcccccgctgccggaccagtgccccgcgctgtgcgagtgctccgaggcagcgcgcacagtcaagtgcgttaaccgcaatctgaccgaggtgcccacggacctgcccgcctacgtgcgcaacctcttccttaccggcaaccagctggccgtgctccctgccggcgccttcgcccgccggccgccgctggcggagctggccgcgctcaacctcagcggcagccgcctggacgaggtgcgcgcgggcgccttcgagcatctgcccagcctgcgccagctcgacctcagccacaacccactggccgacctcagtcccttcgctttctcgggcagcaatgccagcgtctcggcccccagtccccttgtggaactgatcctgaaccacatcgtgccccctgaagatgagcggcagaaccggagcttcgagggcatggtggtggcggccctgctggcgggccgtgcactgcaggggctccgccgcttggagctggccagcaaccacttcctttacctgccgcgggatgtgctggcccaactgcccagcctcaggcacctggacttaagtaataattcgctggtgagcctgacctacgtgtccttccgcaacctgacacatctagaaagcctccacctggaggacaatgccctcaaggtccttcacaatggcaccctggctgagttgcaaggtctaccccacattagggttttcctggacaacaatccctgggtctgcgactgccacatggcagacatggtgacctggctcaaggaaacagaggtagtgcagggcaaagaccggctcacctgtgcatatccggaaaaaatgaggaatcgggtcctcttggaactcaacagtgctgacctggactgtgacccgattcttcccccatccctgcaaacctcttatgtcttcctgggtattgttttagccctgataggcgctattttcctcctggttttgtatttgaaccgcaaggggataaaaaagtggatgcataacatcagagatgcctgcagggatcacatggaagggtatcattacagatatgaaatcaatgcggaccccagattaacaaacctcagttctaactcggatgtctgagaaatattagaggacagaccaaggacaactctgcatgagatgtagacttaagctttatccctactaggcttgctccactttcatcctccactatagatacaacggactttgactaaaagcagtgaaggggatttgcttccttgttatgtaaagtttctcggtgtgttctgttaatgtaagacgatgaacagttgtgtatagtgttttaccctcttctttttcttggaactcctcaacacgtatggagggatttttcaggtttcagcatgaacatgggcttcttgctgtctgtctctctctcagtacagttcaaggtgtagcaagtgtacccacacagatagcattcaacaaaagctgcctcaactttttcgagaaaaatactttattcataaatatcagttttattctcatgtacctaagttgtggagaaaataattgcatcctataaactgcctgcagacgttagcaggctcttcaaaataactccatggtgcacaggagcacctgcatccaagagcatgcttacattttactgttctgcatattacaaaaaataacttgcaacttcataacttctttgacaaagtaaattacttttttgattgcagtttatatgaaaatgtactgatttttttttaataaactgcatcgagatccaaccgactgaattgttaaaaaaaaaaaaaaataaacattgttaaaacaattacagtgtgtgcaagtttgctttgaaaaaaggatgaagggcaggagtattcaatggtcttggttccgatgataattattacttaacatagctgagaatcaaactgtagcaatgtctaatataaatagacttgggagatcgtttcgaaatgg

SEQ ID NO: 172 - protein, 420 aa, Homo sapiens
MPGGCSRGPAAGDGRLRLARLALVLLGWVSSSSPTSSASSFSSSAPFLASAVSAQPPLPDQCPALCECSEAARTVKCVNRNLTEVPTDLPAYVRNLFLTGNQLAVLPAGAFARRPPLAELAALNLSGSRLDEVRAGAFEHLPSLRQLDLSHNPLADLSPFAFSGSNASVSAPSPLVELILNHIVPPEDERQNRSFEGMVVAALLAGRALQGLRRLELASNHFLYLPRDVLAQLPSLRHLDLSNNSLVSLTYVSFRNLTHLESLHLEDNALKVLHNGTLAELQGLPHIRVFLDNNPWVCDCHMADMVTWLKETEVVQGKDRLTCAYPEKMRNRVLLELNSADLDCDPILPPSLQTSYVFLGIVLALIGAIFLLVLYLNRKGIKKWMHNIRDACRDHMEGYHYRYEINADPRLTNLSSNSDV

SEQ ID NO: 173 - DNA, 5977 bp, Homo sapiens
tgtctctcttacctccttgatgttcggcactatttgtggccggcgtggtggaaggacacagtgaggttctcacccccgccccccgctcctcgctcccatcccagttccatcaaaacgaacccgggccagcgcaaggatctccgagttgcgagtgtgctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttcttttacattcttttttctttctttctttctgccaactttgttttccagtgtttacaaggtgacaaatgtttgactttggttgtgtttaaatgtccgtgtaaaatagctgccttttattttttaaggtaacaaataccacctagaggtaggtaggatcatcccacgcttgctttagcacaggacaactttacaaaacatgattgtttacagctgctcttcccctcttttctgatctgcagtttttgcctgggtcccactcaggtgaaaatccatctcattctggaatggttttgcttttgaatttttggttatttttgtgtttctttgggggttagaccactttctgattagccgccacctgcctgcatctgtgaaaagggatctgctcccaggcgttctcacccttcttttgaaggactccttaggctttgttgaatgaagcagagaagattgtatagttggggctggtcttggtgaacacacattattaccccacacatcccctttgtgtagaaagccaaataaaatctatacataccatttccttttgagcccagaatctagatttgagcggaagagcatgtgtgcttcagggaattagtgtctttttttggaaatctgttgaagtaaagtaacatcggccttctgttcacttaggcagcatttatagaaacaaaagaagaaagaaacaacctactgtctggagtcataacacaactttcctggattggaaaccaagtgggggaaaaaatacagaaactttaagggggatgggaggggggggagaagggaaaagccagccctttgtatagaaattttgcttttttttccctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggaggatcccagaacacacagccctggcccctttgattctagggcctgcacagatctctggttcaaatgcacaggccctcagaatagaggaacatgaagagagatcttagagcacacagtagaatgtgagagcctgggtgtctgagaccgggagggcccagcagtgaggggcaggctcttctggtcaccaggctgttcagtggactcagttcttcatcttgtaatgtcgatggctttgccacaccaggccaagcccatgccataccttgtcaagactgtcaaagtggttgtggttaggtcaaactggttttggttctgatggttaggaagaaacaggtcagccctcagatcacctggcccgggacagctgaccccctagaaccctggctctgccattagctaggacctaagactctgcccacattttggtctgttctctcccattacacataggtttgtctcagcatgcaagagtttttcctttaaaaaaaaaaaaaaaaaaaaaaaaaaagcaatgctttctctaaaatcaaagagggagtcattttattccaagatgttttatcttttatgttaagagatcaaagcttataattttcttttttaatttttgaaggagggatcaactccagtttccaatgtctatgtgtctatgtgtgtatgtgccatacatatgtattcacatgaagaccggcatggccaagttctgctggaggagcactcaagtgtgacgagcagggccactggaccctgcagggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttcaataaaaattgaaagaaaaaagctaaaaaaaaaaaaaaaa

SEQ ID NO: 174 - protein, 848 aa, Homo sapiens
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 175 - DNA, 1108 bp, Homo sapiens
ctggaggcctggctggtgctcacatacaataattaactgctgagtggccttcgcccaatcccaggctccactcctgggctccattcccactccctgcctgtctcctaggccactaaaccacagctgtcccctggaataaggcaagggggagtgtagagcagagcagaagcctgagccagacggagagccacctcctctcccagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgcac

SEQ ID NO: 176 - protein, 257 aa, Homo sapiens
MAQRMTTQLLLLLVWVAVVGEAQTRIAWARTELLNVCMNAKHHKEKPGPEDKLHEQCRPWRKNACCSTNTSQEAHKDVSYLYRFNWNHCGEMAPACKRHFIQDTCLYECSPNLGPWIQQVDQSWRKERVLNVPLCKEDCEQWWEDCRTSYTCKSNWHKGWNWTSGFNKCAVGAACQPFHFYFPTPTVLCNEIWTHSYKVSNYSRGSGRCIQMWFDPAQGNPNEEVARFYAAAMSGAGPWAAWPFLLSLALMLLWLLS

SEQ ID NO: 177 - DNA, 2669 bp, Homo sapiens
cagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccatatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttataggttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttggctgagtgaaggaatgatattcatatattcatttattccatggacatttagttagtgctttttatataccaggcatgatgctgagtgacactcttgtgtatatttccaaatttttgtatagtcgctgcacatatttgaaatcatatattaagactttccaaagatgaggtccctggtttttcatggcaacttgatcagtaaggatttcacctctgtttgtaactaaaaccatctactatatgttagacatgacattctttttctctccttcctgaaaaataaagtgtgggaagagacaaaaaaaaaaaaa

SEQ ID NO: 178 - protein, 560 aa, Homo sapiens
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 179 - DNA, 1440 bp, Homo sapiens
gttacccagcattgtgagtgacagagcctggatctgaacgctgatcccataatgcatcctcaagtggtcatcttaagcctcatcctacatctggcagattctgtagctggttctgtaaaggttggtggagaggcaggtccatctgtcacactaccctgccactacagtggagctgtcacatcaatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaacgacaactgttccaacaacaatgagcattccaacgacaacgactgttccgacgacaatgactgtttcaacgacaacgagcgttccaacgacaacgagcattccaacaacaacaagtgttccagtgacaacaacggtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaaagtatttcttcaaaaaggaggttcaacaactaagtgtttcatttagcagccttcaaattaaagctttgcaaaatgcagttgaaaaggaagtccaagcagaagacaatatctacattgagaatagtctttatgccacggactaagacccagtggtgctctttgagagtttacgcccatgactgcagaagactgaacaggtatcagcacatcagatgtcttttagactccaagacaatttttctgtttcagtttcatctggcattccaacatgtcagtgatactgggtagagtaactctcccactccaaactgtgtatagtcaacctcatcattaatgtagtcctaatttgttttgctaaaactggctcaatccttctgatcattgcagagttttctctcaaacatgaacactttagaattgtatgttctctttagaccccataaatcctgtat

SEQ ID NO: 180 - protein, 359 aa, Homo sapiens
MHPQVVILSLILHLADSVAGSVKVGGEAGPSVTLPCHYSGAVTSMCWNRGSCSLFTCQNGIVWTNGTHVTYRKDTRYKLLGDLSRRDVSLTIENTAVSDSGVYCCRVEHRGWFNDMKITVSLEIVPPKVTTTPIVTTVPTVTTVRTSTTVPTTTTVPTTTVPTTMSIPTTTTVPTTMTVSTTTSVPTTTSIPTTTSVPVTTTVSTFVPPMPLPRQNHEPVATSPSSPQPAETHPTTLQGAIRREPTSSPLYSYTTDGNDTVTESSDGLWNNNQTQLFLEHSLLTANTTKGIYAGVCISVLVLLALLGVIIAKKYFFKKEVQQLSVSFSSLQIKALQNAVEKEVQAEDNIYIENSLYATD

SEQ ID NO: 181 - DNA, 2671 bp, Homo sapiens
ggtgagtcaccaaggaaggcagcggcagctccactcagccactgcaattgtgtccggaatttattccttctggtgggttcatggtcttgctgacttcaagaatgaagccgctgacctcgcgcataattagcatcatcattattctggctggagcaattgcactcatcattggctttggtatttcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggagccttcagcatgccggaagtgaatgtggactataatgccagctcagagaccttgcggtgtgaggctccccgatggttcccccggcccacagtggtctgggcatcccaagttgaccagggagccaacttctcggaagtctccaataccagctttgagctgaactctgagaatgtgaccatgaaggtagtgtctgtgctctacaatgttacgatcaacaacacatactcctgtatggttgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgccttggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagacaagtgtgttaagagtgataagtaaaatgcacgtggagacaagtgcatccccagatctcagggacctccccctgcctgtcacctggggagtgagaggacaggatagtgcatgttctttgtctctgaatttttagttatatgtgccgtaatgttgctctgaggaagcccctggaaagtctatcccaacatatccacatcttatattccacaaattaagctgtagtatgtaccctaagacgctgctaattgactgccacttcgcaactcaggggcggctgcattttagtaatgggtcaaatgattcactttttatgatgcttccaaaggtgccttggcttctcttcccaactgacaaatgccaaagttgagaaaaatgatcataattttagcataaacagagcagtcggcgacaccgattttataaataaactgagcaccttctttttaaacaaacaaatgcgggtttatttctcagatgatgttcatccgtgaatggtccagggaaggacctttcaccttgtctatatggcattatgtcatcacaagctctgaggcttctcctttccatcctgcgtggacagctaagacctcagttttcaatagcatctagagcagtgggactcagctggggtgatttcgccccccatctccgggggaatgtctgaagacaattttggttacctcaatgagggagtggaggaggatacagtgccactaccaactagtggatagaggccagggatgctgctcaacctcctaccatgtacaggacgtctccccattacaactacccaatccgaagtgtcaactgtgtcagggctaaggaaccctggttttgagtagaaaagggcctggaaagaggggagccaacaaatctgtctgcttcctcacattagtcattggcaaataagcattctgtctctttggctgctgcctcagcacagagagccagaactctatcgggcaccaggataacatctctcagtgaacagagttgacaaggcctatgggaaatgcctgatgggattatcttcagcttgttgagcttctaagtttctttcccttcattctaccctgcaagccaagttctgtaagagaaatgcctgagttctagctcaggttttcttactctgaatttagatctccagaccctgcctggccacaattcaaattaaggcaacaaacatataccttccatgaagcacacacagacttttgaaagcaaggacaatgactgcttgaattgaggccttgaggaatgaagctttgaaggaaaagaatactttgtttccagcccccttcccacactcttcatgtgttaaccactgccttcctggaccttggagccacggtgactgtattacatgttgttatagaaaactgattttagagttctgatcgttcaagagaatgattaaatatacatttcctacaaaaaaaaaaaaaaaaaaaaaaaaaaaaaaaaaataaaaaaaaaaaaaaaaaa

SEQ ID NO: 182 - DNA, 1164 bp, Homo sapiens
agtggggccaggggagtcatctttttccgttgcgggtacccacctgccgctggccagcattgccccagaggcatccttgggtggctgcttgtataaactgcaaggtccacaaagtgttgaacaagttgttgaatgttttggccaacactgcacctgctgtcttccctacagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgtttttgtttttttgtttttgtttttgtttttacactcgctgctctcaataaataagcctttttta

SEQ ID NO: 183 - protein, 1070 aa, Homo sapiens
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLEKLKFTPPPQPQQCMEFDKEATVPCSATGREKPTIKWERADGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTIGLSVGAAVAYIIAVLGLMFYCKKRCKAKRLQKQPEGEEPEMECLNGGPLQNGQPSAEIQEEVALTSLGSGPAATNKRHSTSDKMHFPRSSLQPITTLGKSEFGEVFLAKAQGLEEGVAETLVLVKSLQSKDEQQQLDFRRELEMFGKLNHANVVRLLGLCREAEPHYMVLEYVDLGDLKQFLRISKSKDEKLKSQPLSTKQKVALCTQVALGMEHLSNNRFVHKDLAARNCLVSAQRQVKVSALGLSKDVYNSEYYHFRQAWVPLRWMSPEAILEGDFSTKSDVWAFGVLMWEVFTHGEMPHGGQADDEVLADLQAGKARLPQPEGCPSKLYRLMQRCWALSPKDRPSFSEIASALGDSTVDSKP

SEQ ID NO: 184 - DNA, 1229 bp, Homo sapiens
ttcctttctctctcagctctccgtctctctttctctctcagcctctttctttctccctgtctcccccactgtcagcacctcttctgtgtggtgagtggaccgcttaccccactaggtgaagatgtcagcccaggagagctgcctcagcctcatcaagtcctcggcagcctgatcttctgcttcggcatctggatcctcattgacaagaccagcttcgtgtcctttgtgggcttggccttcgtgcctctgcagatctggtccaaagtcctggccatctcaggaatcttcaccatgggcatcgccctcctgggttgtgtgggggccctcaaggagctccgctgcctcctgggcctgtattttgggatgctgctgctcctgtttgccacacagatcaccctgggaatcctcatctccactcagcgggcccagctggagcgaagcttgcgggacgtcgtagagaaaaccatccaaaagtacggcaccaaccccgaggagaccgcggccgaggagagctgggactatgtgcagttccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgagggctgcgcgcagggcctccagaagtggctgcacaacaaccttatttccatagtgggcatttgcctgggcgtcggcctactcgagctcgggttcatgacgctctcgatattcctgtgcagaaacctggaccacgtctacaaccggctcgctcgataccgttaggccccgccctccccaaagtcccgccccgcccccgtcacgtgcgctgggcacttccctgctgcctgtaaatatttgtttaatccccagttcgcctggagccctccgccttcacattcccctggggacccacgtggctgcgtgcccctgctgctgtcacctctcccacgggacctggggctttcgtccacagcttcctgtccccatctgtcggcctaccaccacccacaagattatttttcacccaaacctcaaataaatcccctgcgtttttggtaaaaaaaaaaaaaaaaaaaaaa

SEQ ID NO: 185 - protein, 213 aa, Homo sapiens
MGIALLGCVGALKELRCLLGLYFGMLLLLFATQITLGILISTQRAQLERSLRDVVEKTIQKYGTNPEETAAEESWDYVQFQLRCCGWHYPQDWFQVLILRGNGSEAHRVPCSCYNLSATNDSTILDKVILPQLSRLGHLARSRHSADICAVPAESHIYREGCAQGLQKWLHNNLISIVGICLGVGLLELGFMTLSIFLCRNLDHVYNRLARYR

SEQ ID NO: 186 - DNA, 3148 bp, Homo sapiens
gtgggaagggcctgtgggtttattataaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagacttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggca

SEQ ID NO: 187 - protein, 310 aa, Homo sapiens
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHQASTTTATTAQEPATSHPHRDMQPGHHETSTPAGPSQADLHTPHTEDGGPSATERAAEDGASSQLPAAEGSGEQDFTFETSGENTAVVAVEPDRRNQSPVDQGATGASQGLLDRKEVLGGVIAGGLVGLIFAVCLVGFMLYRMKKKDEGSYSLEEPKQANGGAYQKPTKQEEFYA

SEQ ID NO: 188 - DNA, 1506 bp, Homo sapiens
ctgcctggggagcccccccgccccacatcctgccccgcaaaaggcagcttcaccaaagtggggtatttccagcctttgtagctttcacttccacatctaccaagtgggcggagtggccttctgtggacgaatcagattcctctccagcaccgactttaagaggcgagccggggggtcagggtcccagatgcacaggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctcccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagcccctcccccatctcccaccctgtacctcatcccatgagaccctggtgcctggctctttcgtcacccttggacaagacaaaccaagtcggaacagcagataacaatgcagcaaggccctgctgcccaatctccatctgtcaacaggggcgtgaggtcccaggaagtggccaaaagctagacagatccccgttcctgacatcacagcagcctccaacacaaggctccaagacctaggctcatggacgagatgggaaggcacagggagaagggataaccctacacccagaccccaggctggacatgctgactgtcctctcccctccagcctttggccttggcttttctagcctatttacctgcaggctgagccactctcttccctttccccagcatcactccccaaggaagagccaatgttttccacccataatcctttctgccgacccctagttccctctgctcagccaagcttgttatcagctttcagggccatggttcacattagaataaaaggtagtaattagaacaaaaaaaaaaaaaaaaaa

SEQ ID NO: 189 - protein, 232 aa, Homo sapiens
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPM

SEQ ID NO: 190 - DNA, 5616 bp, Homo sapiens
ccccggcgcagcgcggccgcagcagcctccgccccccgcacggtgtgagcgcccgacgcggccgaggcggccggagtcccgagctagccccggcggccgccgccgcccagaccggacgacaggccacctcgtcggcgtccgcccgagtccccgcctcgccgccaacgccacaaccaccgcgcacggccccctgactccgtccagtattgatcgggagagccggagcgagctcttcggggagcagcgatgcgaccctccgggacggccggggcagcgctcctggcgctgctggctgcgctctgcccggcgagtcgggctctggaggaaaagaaagtttgccaaggcacgagtaacaagctcacgcagttgggcacttttgaagatcattttctcagcctccagaggatgttcaataactgtgaggtggtccttgggaatttggaaattacctatgtgcagaggaattatgatctttccttcttaaagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacaggaaatcctgcatggcgccgtgcggttcagcaacaaccctgccctgtgcaacgtggagagcatccagtggcgggacatagtcagcagtgactttctcagcaacatgtcgatggacttccagaaccacctgggcagctgccaaaagtgtgatccaagctgtcccaatgggagctgctggggtgcaggagaggagaactgccagaaactgaccaaaatcatctgtgcccagcagtgctccgggcgctgccgtggcaagtcccccagtgactgctgccacaaccagtgtgctgcaggctgcacaggcccccgggagagcgactgcctggtctgccgcaaattccgagacgaagccacgtgcaaggacacctgccccccactcatgctctacaaccccaccacgtaccagatggatgtgaaccccgagggcaaatacagctttggtgccacctgcgtgaagaagtgtccccgtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcctcttacacccagtggagaagctcccaaccaagctctcttgaggatcttgaaggaaactgaattcaaaaagatcaaagtgctgggctccggtgcgttcggcacggtgtataagggactctggatcccagaaggtgagaaagttaaaattcccgtcgctatcaaggaattaagagaagcaacatctccgaaagccaacaaggaaatcctcgatgaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatattggctcccagtacctgctcaactggtgtgtgcagatcgcaaagggcatgaactacttggaggaccgtcgcttggtgcaccgcgacctggcagccaggaacgtactggtgaaaacaccgcagcatgtcaagatcacagattttgggctggccaaactgctgggtgcggaagagaaagaataccatgcagaaggaggcaaagtgcctatcaagtggatggcattggaatcaattttacacagaatctatacccaccagagtgatgtctggagctacggggtgaccgtttgggagttgatgacctttggatccaagccatatgacggaatccctgccagcgagatctcctccatcctggagaaaggagaacgcctccctcagccacccatatgtaccatcgatgtctacatgatcatggtcaagtgctggatgatagacgcagatagtcgcccaaagttccgtgagttgatcatcgaattctccaaaatggcccgagacccccagcgctaccttgtcattcagggggatgaaagaatgcatttgccaagtcctacagactccaacttctaccgtgccctgatggatgaagaagacatggacgacgtggtggatgccgacgagtacctcatcccacagcagggcttcttcagcagcccctccacgtcacggactcccctcctgagctctctgagtgcaaccagcaacaattccaccgtggcttgcattgatagaaatgggctgcaaagctgtcccatcaaggaagacagcttcttgcagcgatacagctcagaccccacaggcgccttgactgaggacagcatagacgacaccttcctcccagtgcctgaatacataaaccagtccgttcccaaaaggcccgctggctctgtgcagaatcctgtctatcacaatcagcctctgaaccccgcgcccagcagagacccacactaccaggacccccacagcactgcagtgggcaaccccgagtatctcaacactgtccagcccacctgtgtcaacagcacattcgacagccctgcccactgggcccagaaaggcagccaccaaattagcctggacaaccctgactaccagcaggacttctttcccaaggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattttgggaagttgcattcctttgtcttcaaactgtgaagcatttacagaaacgcatccagcaagaatattgtccctttgagcagaaatttatctttcaaagaggtatatttgaaaaaaaaaaaaagtatatgtgaggatttttattgattggggatcttggagtttttcattgtcgctattgatttttacttcaatgggctcttccaacaaggaagaagcttgctggtagcacttgctaccctgagttcatccaggcccaactgtgagcaaggagcacaagccacaagtcttccagaggatgcttgattccagtggttctgcttcaaggcttccactgcaaaacactaaagatccaagaaggccttcatggccccagcaggccggatcggtactgtatcaagtcatggcaggtacagtaggataagccactctgtcccttcctgggcaaagaagaaacggaggggatggaattcttccttagacttacttttgtaaaaatgtccccacggtacttactccccactgatggaccagtggtttccagtcatgagcgttagactgacttgtttgtcttccattccattgttttgaaactcagtatgctgcccctgtcttgctgtcatgaaatcagcaagagaggatgacacatcaaataataactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggggcatagatcagaagactacaaaaatgaagctgctctgaaatctcctttagccatcaccccaaccccccaaaattagtttgtgttacttatggaagatagttttctccttttacttcacttcaaaagctttttactcaaagagtatatgttccctccaggtcagctgcccccaaaccccctccttacgctttgtcacacaaaaagtgtctctgccttgagtcatctattcaagcacttacagctctggccacaacagggcattttacaggtgcgaatgacagtagcattatgagtagtgtggaattcaggtagtaaatatgaaactagggtttgaaattgataatgctttcacaacatttgcagatgttttagaaggaaaaaagttccttcctaaaataatttctctacaattggaagattggaagattcagctagttaggagcccaccttttttcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaagaaagtatttgatttttgtctcaatgaaaataaaactatattcatttccactctaaaaaaaaaaaaaaaaa

SEQ ID NO: 191 - protein, 1210 aa, Homo sapiens [sequence omitted]

SEQ ID NO: 192 - DNA, 4975 bp, Homo sapiens
ctctcacacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggggggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggggtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtagaagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctc

SEQ ID NO: 193 - protein, 1342 aa, Homo sapiens
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMGGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGGSCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 194 - DNA, 4541 bp, Homo sapiens
ggatcctctagggtcccagctcgcctcgatggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctggcagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcaggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccgaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtctgcgtagatggtgaatgtcatatcctgggtagagtggtgcggccagggccagatggggtcccacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcggcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggtcatttggtgtgctgctgtgggaactgctgacacggggtgccccaccataccgccacattgacccttttgaccttacccacttcctggcccagggtcggcgcctgccccagcctgagtattgccctgattctctgtaccaagtgatgcagcaatgctgggaggcagacccagcagtgcgacccaccttcagagtactagtgggggaggtggagcagatagtgtctgcactgcttggggaccattatgtgcagctgccagcaacctacatgaacttgggccccagcacctcgcatgagatgaatgtgcgtccagaacagccgcagttctcacccatgccagggaatgtacgccggccccggccactctcagagcctcctcggcccacttgacttagttcttgggctggacctgcttagctgccttgagctaaccccaaggctgcctctgggccatgccaggccagagcagtggccctccaccttgttcctgccctttaactttcagaggcaataggtaaatgggcccattaggtccctcactccacagagtgagccagtgagggcagtcctgcaacatgtatttatggagtgcctgctgtggaccctgtcttctgggcacagtggactcagcagtgaccacaccaacactgacccttgaaccaataaaggaacaaatgactattaaagcacaaaaaaaaaa

SEQ ID NO: 195 - protein, 661 aa, Homo sapiens
MELLPPLPQSFLLLLLLPAKPAAGEDWQCPRTPYAASRDFDVKYVVPSFSAGGLVQAMVTYEGDRNESAVFVAIRNRLHVLGPDLKSVQSLATGPAGDPGCQTCAACGPGPHGPPGDTDTKVLVLDPALPALVSCGSSLQGRCFLHDLEPQGTAVHLAAPACLFSAHHNRPDDCPDCVASPLGTRVTVVEQGQASYFYVASSLDAAVAGSFSPRSVSIRRLKADASGFAPGFVALSVLPKHLVSYSIEYVHSFHTGAFVYFLTVQPASVTDDPSALHTRLARLSATEPELGDYRELVLDCRFAPKRRRRGAPEGGQPYPVLQVAHSAPVGAQLATELSIAEGQEVLFGVFVTGKDGGPGVGPNSVVCAFPIDLLDTLIDEGVERCCESPVHPGLRRGLDFFQSPSFCPNPPGLEALSPNTSCRHFPLLVSSSFSRVDLFNGLLGPVQVTALYVTRLDNVTVAHMGTMDGRILQVELVRSLNYLLYVSNFSLGDSGQPVQRDVSRLGDHLLFASGDQVFQVPIRGPGCRHFLTCGRCLRAWHFMGCGWCGNMCGQQKECPGSWQQDHCPPKLTEFHPHSGPLRGSTRLTLCGSNFYLHPSGLVPEGTHQVTVGQSPCRPLPKDSSKLRPVPRKDFVEEFECELEPLGTQAVGPTNVSLTVTN

SEQ ID NO: 196 - DNA, 3935 bp, Homo sapiens
aggggcagaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtggtactgctggactttgctgcagctggaggggagctcggctggctcacacacccgtatggcaaagggtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccaggcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgacccccctccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtccccggagggatctggcaacttggcggtgattggcggcgtggctgtcggtgtggtcctgcttctggtgctggcaggagttggcttctttatccaccgcaggaggaagaaccagcgtgcccgccagtccccggaggacgtttacttctccaagtcagaacaactgaagcccctgaagacatacgtggacccccacacatatgaggaccccaaccaggctgtgttgaagttcactaccgagatccatccatcctgtgtcactcggcagaaggtgatcggagcaggagagtttggggaggtgtacaagggcatgctgaagacatcctcggggaagaaggaggtgccggtggccatcaagacgctgaaagccggctacacagagaagcagcgagtggacttcctcggcgaggccggcatcatgggccagttcagccaccacaacatcatccgcctagagggcgtcatctccaaatacaagcccatgatgatcatcactgagtacatggagaatggggccctggacaagttccttcgggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacgaggtgatgaaagccatcaatgatggcttccggctccccacacccatggactgcccctccgccatctaccagctcatgatgcagtgctggcagcaggagcgtgcccgccgccccaagttcgctgacatcgtcagcatcctggacaagctcattcgtgcccctgactccctcaagaccctggctgactttgacccccgcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgacgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggactttatttatttctagttctttcctccccctgcaacttccgctgaggggtctcggatgacaccctggcctgaactgaggagatgaccagggatgctgggctgggccctctttccctgcgagacgcacacagctgagcacttagcaggcaccgccacgtcccagcatccctggagcaggagccccgccacagccttcggacagacatataggatattcccaagccgaccttccctccgccttctcccacatgaggccatctcaggagatggagggcttggcccagcgccaagtaaacagggtacctcaagccccatttcctcacactaagagggcagactgtgaacttgactgggtgagacccaaagcggtccctgtccctctagtgccttctttagaccctcgggccccatcctcatccctgactggccaaacccttgctttcctgggcctttgcaagatgcttggttgtgttgaggtttttaaatatatattttgtactttgtggagaaaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaaaaaaaaaaaaaa

SEQ ID NO: 197 - protein, 976 aa, Homo sapiens
MELQAARACFALLWGCALAAAAAAQGKEVVLLDFAAAGGELGWLTHPYGKGWDLMQNIMNDMPIYMYSVCNVMSGDQDNWLRTNWVYRGEAERIFIELKFTVRDCNSFPGGASSCKETFNLYYAESDLDYGTNFQKRLFTKIDTIAPDEITVSSDFEARHVKLNVEERSVGPLTRKGFYLAFQDIGACVALLSVRVYYKKCPELLQGLAHFPETIAGSDAPSLATVAGTCVDHAVVPPGGEEPRMHCAVDGEWLVPIGQCLCQAGYEKVEDACQACSPGFFKFEASESPCLECPEHTLPSPEGATSCECEEGFFRAPQDPASMPCTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSPEGSGNLAVIGGVAVGVVLLLVLAGVGFFIHRRRKNQRARQSPEDVYFSKSEQLKPLKTYVDPHTYEDPNQAVLKFTTEIHPSCVTRQKVIGAGEFGEVYKGMLKTSSGKKEVPVAIKTLKAGYTEKQRVDFLGEAGIMGQFSHHNIIRLEGVISKYKPMMIITEYMENGALDKFLREKDGEFSVLQLVGMLRGIAAGMKYLANMNYVHRDLAARNILVNSNLVCKVSDFGLSRVLEDDPEATYTTSGGKIPIRWTAPEAISYRKFTSASDVWSFGIVMWEVMTYGERPYWELSNHEVMKAINDGFRLPTPMDCPSAIYQLMMQCWQQERARRPKFADIVSILDKLIRAPDSLKTLADFDPRVSIRLPSTSGSEGVPFRTVSEWLESIKMQQYTEHFMAAGYTAIEKVVQMTNDDIKRIGVRLPGHQKRIAYSLLGLKDQVNTVGIPI

SEQ ID NO: 198 - DNA, 1146 bp, Homo sapiens
cctcaatgacactcatggaggaaatgctgagagaagcattcagatgcatgacacaaggtaagactgccaaaaatcttgttcttgctctcctcattttgttatttgttttatttttaggagttttgagagcaaaatgacaacacccagaaattcagtaaatgggactttcccggcagagccaatgaaaggccctattgctatgcaatctggtccaaaaccactcttcaggaggatgtcttcactggtgggccccacgcaaagcttcttcatgagggaatctaagactttgggggctgtccagattatgaatgggctcttccacattgccctggggggtcttctgatgatcccagcagggatctatgcacccatctgtgtgactgtgtggtaccctctctggggaggcattatgtatattatttccggatcactcttggcagcaacggagaaaaactctaggaagtgtttggtcaaaggaaaaatgataatgaattcattgagcctctttgctgccatttctggaatgattctttcaatcatggacatacttaatattaaaatttcccattttttaaaaatggagagtctgaattttattagagctcacacaccatatattaacatatacaactgtgaaccagctaatccctctgagaaaaactccccatctacccaatactgttacagcatacaatctctgttcttgggcattttgtcagtgatgctgatctttgccttcttccaggaacttgtaatagctggcatcgttgagaatgaatggaaaagaacgtgctccagacccaaatctaacatagttctcctgtcagcagaagaaaaaaaagaacagactattgaaataaaagaagaagtggttgggctaactgaaacatcttcccaaccaaagaatgaagaagacattgaaattattccaatccaagaagaggaagaagaagaaacagagacgaactttccagaacctccccaagatcaggaatcctcaccaatagaaaatgacagctctccttaagtgatttcttctgttttctgtttccttttttaaacattagtgttcatagcttccaagagacatgctgactttcatttcttgaggtactctgcacatacgcaccacatctctatctggcc

SEQ ID NO: 199 - protein, 297 aa, Homo sapiens
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHFLKMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 200 - DNA, 8605 bp, Homo sapiens
aattcgccaactgaaaaagtgggaaaggatgtctggaggcgaggcgtcccattacagaggaaggagctcgctatataagccagccaaagttggctgcaccggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtggatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtaaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacataacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacagcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctgaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgagtttgttattttgctttgaattgttgagtctgaatttcaccaaagccaatcatttgaacaaagcggggaatgttgggataggaaaggtaagtagggatagtggtcaagtgggaggggtggaaaggagactaaagactgggagagagggaagcactttttttaaataaagttgaacacacttgggaaaagcttacaggccaggcctgtaatcccaacactttgggaggccaaggtgggaggatagcttaaccccaggagtttgagaccagcctgagcaacatagtgagaacttgtctctacagaaaaaaaaaaaaaaaaaaatttaattaggcaagcgtggtagtgcgcacctgtcgtcccagctactcaggaggctgaggtaggaaaatcactggagcccaggagttagaggttacagtgagctatgatcacactactgcactccagcctgggcaacagagggagaccctgtctctaaataaaaaaagaaaagaaaaaaaaagcttacaacttgagattcagcatcttgctcagtatttccaagactaatagattatggtttaaaagatgcttttatactcattttctaatgcaactcctagaaactctatgatatagttgaggtaagtattgttaccacacatgggctaagatccccagaggcagactgcctgagttcaattcttggctccaccattcccaagttccctaacctctctatgcctcagtttcctcttctgtaaagtagggacactcatacttctcatttcagaacatttttgtgaagaataaattatgttatccatttgaggcccttagaatggtacccggtgtatattaagtgctagtacatgttagctatcatcattatcactttatatgagatggactggggttcatagaaacccaatgacttgattgtggctactactcaataaataatagaatttggatttaaaaaaaa

SEQ ID NO: 201 - protein, 2201 aa, Homo sapiens
MGAMTQLLAGVFLAFLALATEGGVLKKVIRHKRQSGVNATLPEENQPVVFNHVYNIKLPVGSQCSVDLESASGEKDLAPPSEPSESFQEHTVDGENQIVFTHRINIPRRACGCAAAPDVKELLSRLEELENLVSSLREQCTAGAGCCLQPATGRLDTRPFCSGRGNFSTEGCGCVCEPGWKGPNCSEPECPGNCHLRGRCIDGQCICDDGFTGEDCSQLACPSDCNDQGKCVNGVCICFEGYAGADCSREICPVPCSEEHGTCVDGLCVCHDGFAGDDCNKPLCLNNCYNRGRCVENECVCDEGFTGEDCSELICPNDCFDRGRCINGTCYCEEGFTGEDCGKPTCPHACHTQGRCEEGQCVCDEGFAGVDCSEKRCPADCHNRGRCVDGRCECDDGFTGADCGELKCPNGCSGHGRCVNGQCVCDEGYTGEDCSQLRCPNDCHSRGRCVEGKCVCEQGFKGYDCSDMSCPNDCHQHGRCVNGMCVCDDGYTGEDCRDRQCPRDCSNRGLCVDGQCVCEDGFTGPDCAELSCPNDCHGQGRCVNGQCVCHEGFMGKDCKEQRCPSDCHGQGRCVDGQCICHEGFTGLDCGQHSCPSDCNNLGQCVSGRCICNEGYSGEDCSEVSPPKDLVVTEVTEETVNLAWDNEMRVTEYLVVYTPTHEGGLEMQFRVPGDQTSTIIQELEPGVEYFIRVFAILENKKSIPVSARVATYLPAPEGLKFKSIKETSVEVEWDPLDIAFETWEIIFRNMNKEDEGEITKSLRRPETSYRQTGLAPGQEYEISLHIVKNNTRGPGLKRVTTTRLDAPSQIEVKDVTDTTALITWFKPLAEIDGIELTYGIKDVPGDRTTIDLTEDENQYSIGNLKPDTEYEVSLISRRGDMSSNPAKETFTTGLDAPRNLRRVSQTDNSITLEWRNGKAAIDSYRIKYAPISGGDHAEVDVPKSQQATTKTTLTGLRPGTEYGIGVSAVKEDKESNPATINAATELDTPKDLQVSETAETSLTLLWKTPLAKFDRYRLNYSLPTGQWVGVQLPRNTTSYVLRGLEPGQEYNVLLTAEKGRHKSKPARVKASTEQAPELENLTVTEVGWDGLRLNWTAADQAYEHFIIQVQEANKVEAARNLTVPGSLRAVDIPGLKAATPYTVSIYGVIQGYRTPVLSAEASTGETPNLGEVVVAEVGWDALKLNWTAPEGAYEYFFIQVQEADTVEAAQNLTVPGGLRSTDLPGLKAATHYTITIRGVTQDFSTTPLSVEVLTEEVPDMGNLTVTEVSWDALRLNWTTPDGTYDQFTIQVQEADQVEEAHNLTVPGSLRSMEIPGLRAGTPYTVTLHGEVRGHSTRPLAVEVVTEDLPQLGDLAVSEVGWDGLRLNWTAADNAYEHFVIQVQEVNKVEAAQNLTLPGSLRAVDIPGLEAATPYRVSIYGVIRGYRTPVLSAEASTAKEPEIGNLNVSDITPESFNLSWMATDGIFETFTIEIIDSNRLLETVEYNISGAERTAHISGLPPSTDFIVYLSGLAPSIRTKTISATATTEALPLLENLTISDINPYGFTVSWMASENAFDSFLVTVVDSGKLLDPQEFTLSGTQRKLELRGLITGIGYEVMVSGFTQGHQTKPLRAEIVTEAEPEVDNLLVSDATPDGFRLSWTADEGVFDNFVLKIRDTKKQSEPLEITLLAPERTRDITGLREATEYEIELYGISKGRRSQTVSAIATTAMGSPKEVIFSDITENSATVSWRAPTAQVESFRITYVPITGGTPSMVTVDGTKTQTRLVKLIPGVEYLVSIIAMKGFEESEPVSGSFTTALDGPSGLVTANITDSEALARWQPAIATVDSYVISYTGEKVPEITRTVSGNTVEYALTDLEPATEYTLRIFAEKGPQKSSTITAKFTTDLDSPRDLTATEVQSETALLTWRPPRASVTGYLLVYESVDGTVKEVIVGPDTTSYSLADLSPSTHYTAKIQALNGPLRSNMIQTIFTTIGLLYPFPKDCSQAMLNGDTTSGLYTIYLNGDKAEALEVFCDMTSDGGGWIVFLRRKNGRENFYQNWKAYAAGFGDRREEFWLGLDNLNKITAQGQYELRVDLRDHGETAFAVYDKFSVGDAKTRYKLKVEGYSGTAGDSMAYHNGRSFSTFDKDTDSAITNCALSYKGAFWYRNCHRVNLMGRYGDNNHSQGVNWFHWKGHEHSIQFAEMKLRPSNFRNLEGRRKRA

SEQ ID NO: 202 - DNA, 2814 bp, Homo sapiens
aagaacgcccccaaaatctgtttctaattttacagaaatcttttgaaacttggcacggtattcaaaagtccgtggaaagaaaaaaaccttgtcctggcttcagcttccaactacaaagacagacttggtccttttcaacggttttcacagatccagtgacccacgctctgaagacagaattagctaactttcaaaaacatctggaaaaatgaagacttgggtaaaaatcgtatttggagttgccacctctgctgtgcttgccttattggtgatgtgcattgtcttacgcccttcaagagttcataactctgaagaaaatacaatgagagcactcacactgaaggatattttaaatggaacattttcttataaaacattttttccaaactggatttcaggacaagaatatcttcatcaatctgcagataacaatatagtactttataatattgaaacaggacaatcatataccattttgagtaatagaaccatgaaaagtgtgaatgcttcaaattacggcttatcacctgatcggcaatttgtatatctagaaagtgattattcaaagctttggagatactcttacacagcaacatattacatctatgaccttagcaatggagaatttgtaagaggaaatgagcttcctcgtccaattcagtatttatgctggtcgcctgttgggagtaaattagcatatgtctatcaaaacaatatctatttgaaacaaagaccaggagatccaccttttcaaataacatttaatggaagagaaaataaaatatttaatggaatcccagactgggtttatgaagaggaaatgcttcctacaaaatatgctctctggtggtctcctaatggaaaatttttggcatatgcggaatttaatgataaggatataccagttattgcctattcctattatggcgatgaacaatatcctagaacaataaatattccatacccaaaggctggagctaagaatcccgttgttcggatatttattatcgataccacttaccctgcgtatgtaggtccccaggaagtgcctgttccagcaatgatagcctcaagtgattattatttcagttggctcacgtgggttactgatgaacgagtatgtttgcagtggctaaaaagagtccagaatgtttcggtcctgtctatatgtgacttcagggaagactggcagacatgggattgtccaaagacccaggagcatatagaagaaagcagaactggatgggctggtggattctttgtttcaagaccagttttcagctatgatgccatttcgtactacaaaatatttagtgacaaggatggctacaaacatattcactatatcaaagacactgtggaaaatgctattcaaattacaagtggcaagtgggaggccataaatatattcagagtaacacaggattcactgttttattctagcaatgaatttgaagaataccctggaagaagaaacatctacagaattagcattggaagctatcctccaagcaagaagtgtgttacttgccatctaaggaaagaaaggtgccaatattacacagcaagtttcagcgactacgccaagtactatgcacttgtctgctacggcccaggcatccccatttccacccttcatgatggacgcactgatcaagaaattaaaatcctggaagaaaacaaggaattggaaaatgctttgaaaaatatccagctgcctaaagaggaaattaagaaacttgaagtagatgaaattactttatggtacaagatgattcttcctcctcaatttgacagatcaaagaagtatcccttgctaattcaagtgtatggtggtccctgcagtcagagtgtaaggtctgtatttgctgttaattggatatcttatcttgcaagtaaggaagggatggtcattgccttggtggatggtcgaggaacagctttccaaggtgacaaactcctctatgcagtgtatcgaaagctgggtgtttatgaagttgaagaccagattacagctgtcagaaaattcatagaaatgggtttcattgatgaaaaaagaatagccatatggggctggtcctatggaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagactaaaaacgatgcagatgcaagcctgtatcagaatctgaaaaccttatataaacccctcagacagtttgcttattttattttttatgttgtaaaatgctagtataaacaaacaaattaatgttgttctaaaggctgttaaaaaaaagatgaggactcagaagttcaagctaaatattgtttacattttctggtactctgtgaaagaagagaaaagggagtcatgcattttgctttggacacagtgttttatcacctgttcatttgaagaaaaataataaagtcagaagttcaaaaaaaaaaaaaaaaaaaaaaaaagcggccgctcg

SEQ ID NO: 203 - protein, 760 aa, Homo sapiens [sequence omitted]

SEQ ID NO: 204 - DNA, 1815 bp, Homo sapiens
gcagagctctgtgctccctgcagtcaggactctgggaccgcagggggctcccggaccctgactctgcagccgaaccggcacggtttcgtggggacccaggcttgcaaagtgacggtcattttctctttctttctccctcttgagtccttctgagatgatggctctgggcgcagcgggagctacccgggtctttgtcgcgatggtagcggcggctctcggcggccaccctctgctgggagtgagcgccaccttgaactcggttctcaattccaacgctatcaagaacctgcccccaccgctgggcggcgctgcggggcacccaggctctgcagtcagcgccgcgccgggaatcctgtacccgggcgggaataagtaccagaccattgacaactaccagccgtacccgtgcgcagaggacgaggagtgcggcactgatgagtactgcgctagtcccacccgcggaggggacgcaggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaatatcatgaaatgttataagtagacatacattttgggattgtgatcttagaggtttgtgtgtgtgtacgtatgtgtgtgttctacaagaacggaagtgtgatatgtttaaagatgatcagagaaaagacagtgtctaaatataagacaatattgatcagctctagaataactttaaagaaagacgtgttctgcattgataaactcaaatgatcatggcagaatgagagtgaatcttacattactactttcaaaaatagtttccaataaattaataatacctaaaaaaaaaaa

SEQ ID NO: 205 - protein, 266 aa, Homo sapiens
MMALGAAGATRVFVAMVAAALGGHPLLGVSATLNSVLNSNAIKNLPPPLGGAAGHPGSAVSAAPGILYPGGNKYQTIDNYQPYPCAEDEECGTDEYCASPTRGGDAGVQICLACRKRRKRCMRHAMCCPGNYCKNGICVSSDQNHFRGEIEETITESFGNDHSTLDGYSRRTTLSSKMYHTKGQEGSVCLRSSDCASGLCCARHFWSKICKPVLKEGQVCTKHRRKGSHGLEIFQRCYCGEGLSCRIQKDHHQASNSSRLHTCQRH

SEQ ID NO: 206 - DNA, 523 bp, Homo sapiens
ctcctggttcaaaagcagctaaaccaaaagaagcctccagacagccctgagatcacctaaaaagctgctaccaagacagccacgaagatcctaccaaaatgaagcgcttcctcttcctcctactcaccatcagcctcctggttatggtacagatacaaactggactctcaggacaaaacgacaccagccaaaccagcagcccctcagcatccagcaacataagcggaggcattttccttttcttcgtggccaatgccataatccacctcttctgcttcagttgaggtgacacgtctcagccttagccctgtgccccctgaaacagctgccaccatcactcgcaagagaatcccctccatctttgggaggggttgatgccagacatcaccaggttgtagaagttgacaggcagtgccatgggggcaacagccaaaataggggggtaatgatgtaggggccaagcagtgcccagctgggggtcaataaagttacccttgtacttgcaaaaaaaaaaaaaaaaaaa

SEQ ID NO: 207 - protein, 61 aa, Homo sapiens
MKRFLFLLLTISLLVMVQIQTGLSGQNDTSQTSSPSASSNISGGIFLFFVANAIIHLFCFS

SEQ ID NO: 208 - DNA, 2672 bp, Homo sapiens
cttccagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaagagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctatagaaatgtaaatgcaaggtcacacatattaatgacagcctgttgtattaatgatggctccaggtcagtgtctggagtttcattccatcccagggcttggatgtaaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacgtgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctatgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcactccggcctaggcaacgagagcaaaactccaatacaaacaaacaaacaaacacctgtgctaggtcagtctggcacgtaagatgaacatccctaccaacacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagattcaaaaaaaaaaaaaaaa

SEQ ID NO: 209 - protein, 335 aa, Homo sapiens
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSMVLLCLLLVPLLLSLFVLGLFLWFLKRERQEEYIEEKKRVDICRETPNICPHSGENTEYDTIPHTNRTILKEDPANTVYSTVEIPKKMENPHSLLTMPDTPRLFAYENVI

SEQ ID NO: 210 - DNA, 3292 bp, Homo sapiens
ccgcggtggtcccaatctcttccttcctccatgaggtgtctggggtcggggccccagttcttcctggagtccatctggagtctctcctactttctagagaatccattgggtcttgtttacaacgtggatggggacagactgtgcagcgtggagggaaggggagggagggaggtttgggaagagcctcctgtggggtcctgtcactgccccagatgccccaacaccctgtgatacctgcacccctgccacatctgtccctcactccaaactcagctcaaggggatggtggcagggaagaaggtgagcttggaacccaggcagccctggggtcaccacctccagctggggttcctcctctgtaaagtggaggtataacggtacccacctcctggggtggctgtgaggattcagagctgataaggtgaacgcctagggcgggccctggtgcagagagagcgctcagctcctaggctggattaactgtccctggggcacagatctcggtctggggcctgtggaaacctcagagccacccctgaacccccaccgagccacctttgcctcgcagtgccatggcctcgtctccgagttacaggaaaaggcagagaatgcccttctcaggtggccctctgggagagacactctccttgactccaaagccacgcttggctgcaaactgggccagcaccacaaggctgggcaagcaaacatcctaatcccaccaaaaccacaccgacctccaccctgtgacactctgcaacaaacacacggcctactcttgtcacccgggccggccaataagcacggaagaggcaaggcctcagaccctggacagacatcctccctccagaggcacccagggcctcagccttctcctccctccctggcctcaatttctccacctgtgacccagggcaggtggatccagggagaagaaccttctggctccatctcaccgtgggtcctgccagcacacacaaagatttggcctctcaaagcctagctctgccagcgtccttctgctcaagaactctccatgactcccagtggccctaaggacaaagtcctggcatttgaggccctcccaatgcagggccagactctgcctctccagcttcctgtccccaccacacccctgctgtctcacggtggtccgactgtttcctgcttctgttgctttgcttagtctggcaccctgctggcatgctttctcacccttcttccccaatcccaactcacccagtctttcaaagggcaggctaaataccaggcctccaggtggcccaggattcttctctgagctttcatgggcctggccctgggtgctacctgtgagtagtcccacggtgggtacatagtaggtgcgcttactgtttgcaagaatgaacatgggacagtttggggactgtcacccagctcagggagcactgatggggaagcatctcctgtatgtcccagggctcagtgctgtagtgtcctgaccctcagaaatctcataatggcttggtcaggaaggcatcgtgccccactttgcaaacagggggtgctgagaattgaggggccttgtccaaggtctcatggctaggagcaagcagaatcggatttgaacccagggccacgtgacttcagaagtgccattaaagtccccataatttggagctgtcttctttttttttttcttttctttttttttgagaccgagcctcactctgtcacctaggccaggagtgcagtggtctgatctcagctcactgcaacctccgcctcctaggttcaagtgattctctagcctcagcctcccaagtagctgggactacaggcgcacgtcatcatgcccagctaacttttgtatttttagtagagatgggttttcaccatgttggtcaggctggtctcgaactcctgacctcaagtgatccgtctgcctcggcctctcaaagtgctgggattataaggcttgagccactacactcggcctggagctgtgttttgtcggtgaaggattttccacccatgaaggggtcagacgtgaagtgtgtggccctgggcagctcctctgagcccagagacgccagccctagccgccttgctgtgccactttgggacttccctccctagcctgagcttcagttttcctgcctgttaggcagccccatgtcaactgcacttagtaggccgggtttgatgcccgacaagacgtgaagtggtggaggtgggcaggatcccagcgctaccatcttcttgaaccagtgatctcaacacatcggatttctgtttcctcatctgcaaaatgggatcagtgagctcaggtgggtcacaaattctacaggaactactttagccaagcccggccccctgaaagttcccctcggtgggctgttagggtgattgttttcatctgtggggctcctgatgcgtcccacccaccagccttggagagggtgggatgggagggtggggtgcttggggagacaagcctagagcctgggcctcccaccccactgcctccccccatcccagggccccccacccagtgacaaagcccgtggcacttcctctacccggttggcaggcggcctggcccagccccttctctaaggaagcgcatttcctgcctccctgggccggccgggctggatgagccgggagctccctgctgccggtcataccacagccttcatctgcgccctggggccaggactgctgctgtcactgccatccattggagcccagcaccccctccccgcccatccttcggacagcaactccagcccagccccgcgtccctgtgtccacttctcctgaccctcggccgccaccccagaaggctggagcagggacgccgtcgctccggccgcctgctcccctcgggtccccgtgcgagcccacgccggccccggtgcccgcccgcagccctgccactggacacaggataaggcccagcgcacaggcccccacgtggacagcatggaccgcggcacgctccctctggctgttgccctgctgctggccagctgcagcctcagccccacaagtaggtgtccagggacccagggtggggagactcggcctccggtgcacggaccaggccccaagtattcccggcctccttcctgtatcctgagctcacgcccagcagagccatccttggggctctggagggtcaccaaccctcccagtttgctggaactaaatggttatgcaggactttcagtgttgaaagaaagcctcgggcaaactgggctgactctttcactttaaccctggtctctggcgtctgctcacccagctg

SEQ ID NO: 211 - protein, 22 aa, Homo sapiens
MDRGTLPLAVALLLASCSLSPT

SEQ ID NO: 212 - DNA, 1399 bp, Homo sapiens
agtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacacttaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagac

SEQ ID NO: 213 - protein, 346 aa, Homo sapiens
MAMVSEFLKQAWFIENEEQEYVQTVKSSKGGPGSAVSPYPTFNPSSDVAALHKAIMVKGVDEATIIDILTKRNNAQRQQIKAAYLQETGKPLDETLKKALTGHLEEVVLALLKTPAQFDADELRAAMKGLGTDEDTLIEILASRTNKEIRDINRVYREELKRDLAKDITSDTSGDFRNALLSLAKGDRSEDFGVNEDLADSDARALYEAGERRKGTDVNVFNTILTTRSYPQLRRVFQKYTKYSKHDMNKVLDLELKGDIEKCLTAIVKCATSKPAFFAEKLHQAMKGVGTRHKALIRIMVSRSEIDMNDIKAFYQKMYGISLCQAILDETKGDYEKILVALCGGN

SEQ ID NO: 214 - DNA, 3080 bp, Homo sapiens
cactggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctgtgagtccccatttttctcttggagaacccagatagatagtccactgaatgggaaggtgacgaatgaggggaccacatctacgctgacaatgaatcctgttagttttgggaacgaacactcttacctgtgcacagcaacttgtgaatctaggaaattggaaaaaggaatccaggtggagatctactcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagagaaaccatttactgttgagatctcccctggaccccggattgctgctcagattggagactcagtcatgttgacatgtagtgtcatgggctgtgaatccccatctttctcctggagaacccagatagacagccctctgagcgggaaggtgaggagtgaggggaccaattccacgctgaccctgagccctgtgagttttgagaacgaacactcttatctgtgcacagtgacttgtggacataagaaactggaaaagggaatccaggtggagctctactcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaaatcaaaagtgtagctaatgcttgatatgttcaactggagacactatttatctgtgcaaatccttgatactgctcatcattccttgagaaaaacaatgagctgagaggcagacttccctgaatgtattgaacttggaaagaaatgcccatctatgtcccttgctgtgagcaagaagtcaaagtaaaacttgctgcctgaagaacagtaactgccatcaagatgagagaactggaggagttccttgatctgtatatacaataacataatttgtacatatgtaaaataaaattatgccatagcaagattgcttaaaatagcaacactctatatttagattgttaaaataactagtgttgcttggactattataatttaatgcatgttaggaaaatttcacattaatatttgctgacagctgacctttgtcatctttcttctattttattccctttcacaaaattttattcctatatagtttattgacaataatttcaggttttgtaaagatgccgggttttatatttttatagacaaataataagcaaagggagcactgggttgactttcaggtactaaatacctcaacctatggtataatggttgactgggtttctctgtatagtactggcatggtacggagatgtttcacgaagtttgttcatcagactcctgtgcaactttcccaatgtggcctaaaaatgcaacttctttttattttcttttgtaaatgtttaggtttttttgtatagtaaagtgataatttctggaattaaa

SEQ ID NO: 215 - protein, 739 aa, Homo sapiens
MPGKMVVILGASNILWIMFAASQAFKIETTPESRYLAQIGDSVSLTCSTTGCESPFFSWRTQIDSPLNGKVTNEGTTSTLTMNPVSFGNEHSYLCTATCESRKLEKGIQVEIYSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQEKPFTVEISPGPRIAAQIGDSVMLTCSVMGCESPSFSWRTQIDSPLSGKVRSEGTNSTLTLSPVSFENEHSYLCTVTCGHKKLEKGIQVELYSFPRDPEIEMSGGLVNGSSVTVSCKVPSVYPLDRLEIELLKGETILENIEFLEDTDMKSLENKSLEMTFIPTIEDTGKALVCQAKLHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 216 - protein, 5 aa, Artificial sequence
  Synthetic sequence: Heavy chain CDR1
DNYMH

SEQ ID NO: 217 - protein, 17 aa, Artificial sequence
  Synthetic sequence: Heavy chain CDR2
WIDPENGDTEYAPKFRG

SEQ ID NO: 218 - protein, 11 aa, Artificial sequence
  Synthetic sequence: Heavy chain CDR3
LIYAGYLAMDY

SEQ ID NO: 219 - protein, 10 aa, Artificial sequence
  Synthetic sequence: Light chain CDR1
SASSSVTYMH

SEQ ID NO: 220 - protein, 7 aa, Artificial sequence
  Synthetic sequence: Light chain CDR2
STSNLAS

SEQ ID NO: 221 - protein, 9 aa, Artificial sequence
  Synthetic sequence: Light chain CDR3
QQRSTYPLT

SEQ ID NO: 222 - protein, 11 aa, Artificial sequence
  Synthetic sequence: Light chain CDR1
KASQDVGTSVA

SEQ ID NO: 223 - protein, 7 aa, Artificial sequence
  Synthetic sequence: Light chain CDR2
WTSTRHT

SEQ ID NO: 224 - protein, 8 aa, Artificial sequence
  Synthetic sequence: Light chain CDR3
QQYSLYRS

SEQ ID NO: 225 - protein, 5 aa, Artificial sequence
  Synthetic sequence: Heavy chain CDR1
TYWMS

SEQ ID NO: 226 - protein, 17 aa, Artificial sequence
  Synthetic sequence: Heavy chain CDR2
EIHPDSSTINYAPSLKD

SEQ ID NO: 227 - protein, 10 aa, Artificial sequence
  Synthetic sequence: Heavy chain CDR3
LYFGFPWFAY

SEQ ID NO: 228 - protein, 15 aa, Artificial sequence
  Synthetic sequence: Light chain CDR1
KASQSVDYDGDSYLN

SEQ ID NO: 229 - protein, 7 aa, Artificial sequence
  Synthetic sequence: Light chain CDR2
DASNLVS

SEQ ID NO: 230 - protein, 9 aa, Artificial sequence
  Synthetic sequence: Light chain CDR3
QQSTEDPWT

SEQ ID NO: 231 - protein, 5 aa, Artificial sequence
  Synthetic sequence: Heavy chain CDR1
SYWMN

SEQ ID NO: 232 - protein, 17 aa, Artificial sequence
  Synthetic sequence: Heavy chain CDR2
QIWPGDGDTNYNGKFKG

SEQ ID NO: 233 - protein, 15 aa, Artificial sequence
  Synthetic sequence: Heavy chain CDR3
RETTTVGRYYYAMDY

The invention claimed is:

1. A compound which is B:

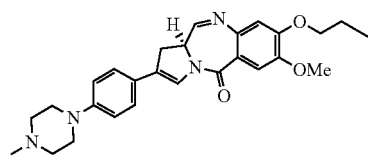

or a pharmaceutically acceptable salt thereof.

2. A conjugate of formula ConjB:

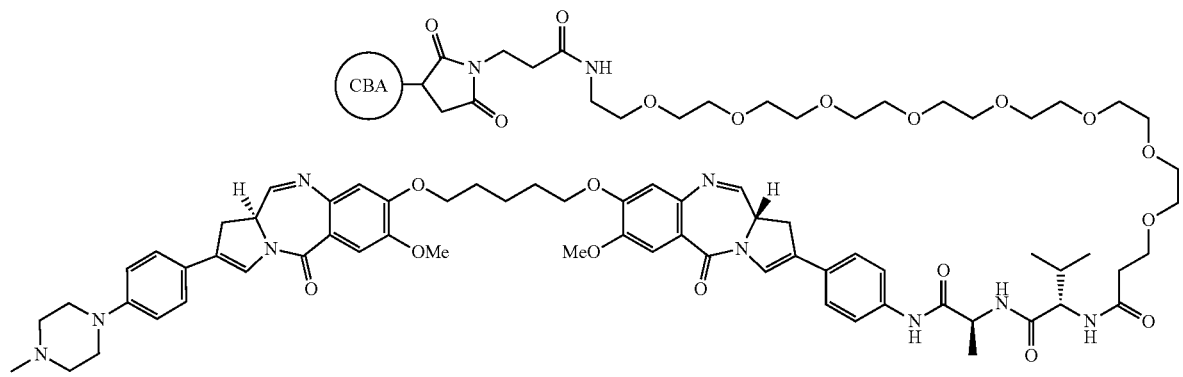

where CBA represents a cell binding agent.

3. The conjugate according to claim 2, wherein the cell binding agent is an antibody or an active fragment thereof.

4. The conjugate according to claim 3, wherein the antibody or antibody fragment is an antibody or antibody fragment for a tumour-associated antigen.

5. The conjugate of claim 3 wherein the antibody or antibody fragment is an antibody which binds to one or more tumor-associated antigens or cell-surface receptors selected from (1)-(88):
  (1) BMPR1B;
  (2) E16;
  (3) STEAP1;
  (4) 0772P;
  (5) MPF;
  (6) Napi3b;
  (7) Sema 5b;
  (8) PSCA hlg;
  (9) ETBR;
  (10) MSG783;
  (11) STEAP2;
  (12) TrpM4;
  (13) CRIPTO;
  (14) CD21;
  (15) CD79b;
  (16) FcRH2;
  (17) HER2;
  (18) NCA;
  (19) MDP;
  (20) IL20R-alpha;
  (21) Brevican;
  (22) EphB2R;
  (23) ASLG659;
  (24) PSCA;
  (25) GEDA;
  (26) BAFF-R;
  (27) CD22;
  (28) CD79a;
  (29) CXCR5;
  (30) HLA-DOB;
  (31) P2X5;
  (32) CD72;
  (33) LY64;
  (34) FcRH1;
  (35) IRTA2;
  (36) TENB2;
  (37) PSMA FOLH1;
  (38) SST;
  (38.1) SSTR2;
  (38.2) SSTR5;
  (38.3) SSTR1;
  (38.4) SSTR3;
  (38.5) SSTR4;
  (39) ITGAV;
  (40) ITGB6;
  (41) CEACAM5;
  (42) MET;
  (43) MUC1;
  (44) CA9;
  (45) EGFRvIII;
  (46) CD33;
  (47) CD19;
  (48) IL2RA;
  (49) AXL;
  (50) CD30—TNFRSF8;
  (51) BCMA—TNFRSF17;
  (52) CT Ags CTA;
  (53) CD174 (Lewis Y)—FUT3;
  (54) CLEC14A;
  (55) GRP78—HSPA5;
  (56) CD70;
  (57) Stem Cell specific antigens;
  (58) ASG-5;
  (59) ENPP3;
  (60) PRR4;
  (61) GCC—GUCY2C;
  (62) Liv-1—SLC39A6;
  (63) 5T4;
  (64) CD56—NCMA1;
  (65) CanAg;
  (66) FOLR1;
  (67) GPNMB;
  (68) TIM-1—HAVCR1;
  (69) RG-1/Prostate tumor target Mindin—Mindin/RG-1;
  (70) B7-H4—VTCN1;
  (71) PTK7;
  (72) CD37;
  (73) CD138—SDC1;
  (74) CD74;
  (75) Claudins—CLs;
  (76) EGFR;
  (77) Her3;

(78) RON—MST1R;
(79) EPHA2;
(80) CD20—MS4A1;
(81) Tenascin C—TNC;
(82) FAP;
(83) DKK-1;
(84) CD52;
(85) CS1—SLAMF7;
(86) Endoglin—ENG;
(87) Annexin A1—ANXA1;
(88) V-CAM (CD106)—VCAM1.

6. The conjugate of claim 2 wherein the antibody or antibody fragment is a cysteine-engineered antibody.

7. The conjugate of claim 2 wherein the drug loading (p) of drugs (D) to antibody (Ab) is an integer from 1 to about 8.

8. The conjugate according to claim 7, wherein p is 1, 2, 3, or 4.

9. A composition comprising a mixture of the drug conjugate compounds of claim 2, wherein the average drug loading per antibody in the mixture of antibody-drug conjugate compounds is about 1 to about 8.

10. A pharmaceutical composition comprising a therapeutically effective amount of the conjugate according to claim 2 and a pharmaceutically acceptable diluent, carrier or excipient.

11. The pharmaceutical composition of claim 10 further comprising a therapeutically effective amount of a chemotherapeutic agent.

12. A method of treating breast cancer comprising administering to a patient in need thereof the pharmaceutical composition of claim 10.

13. The method of claim 12 wherein the patient is administered a chemotherapeutic agent, in combination with the conjugate.

14. A method of preparing a conjugate according to claim 2, the method comprising the step of reacting a cell binding agent with

* * * * *